United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 14

SEQ ID NO: 15003 - DNA, 2455 bp, Homo sapiens
tttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctag

SEQ ID NO: 15004 - DNA, 4665 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcagggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgttggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaaacaaaatgaaccatg

SEQ ID NO: 15005 - DNA, 4251 bp, Homo sapiens
agtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcagggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgttggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaaa

SEQ ID NO: 15006 - DNA, 1809 bp, Homo sapiens
agtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaa

SEQ ID NO: 15007 - DNA, 2971 bp, Homo sapiens
gactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttc

SEQ ID NO: 15008 - DNA, 3042 bp, Homo sapiens
agagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagagccccctttccaggtgcgcgctagctcggagaggagtcccgccggtgcgaggaatctggcgctttgcggagtggcgggccagggccgctgaggttcaaacggtcaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttc

SEQ ID NO: 15009 - DNA, 2745 bp, Homo sapiens
gaggcgaggcggggcgcgactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttc

SEQ ID NO: 15010 - DNA, 2745 bp, Homo sapiens
gaggcgaggcggggcgcgactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttc

SEQ ID NO: 15011 - DNA, 1739 bp, Homo sapiens
agagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccagactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgc

SEQ ID NO: 15012 - DNA, 1704 bp, Homo sapiens
cggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacgccaggtgcggtggctcatgcctgtaatcccagcactttgggaggctgaggcgggcggatcacaagctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaa

SEQ ID NO: 15013 - DNA, 3842 bp, Homo sapiens
tcctcagttcctgcgagcgtcggcttcgtccgggcacttccagtactctcattcacttcctgtccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttatttta

SEQ ID NO: 15014 - DNA, 3730 bp, Homo sapiens
gtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaaatggggtttcgctctgtttgcccaggctggagtgcaatagtgcgatctcggctcactgcaacctctgcctcccgggtttaagtgattctcctatctcagcctcccgagtagctgggtttacaggtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaa

SEQ ID NO: 15015 - DNA, 6401 bp, Homo sapiens
gcgctcaggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttca

SEQ ID NO: 15016 - DNA, 2940 bp, Homo sapiens
agctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtg

SEQ ID NO: 15017 - DNA, 5835 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaa

SEQ ID NO: 15018 - DNA, 5720 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggta

SEQ ID NO: 15019 - DNA, 5047 bp, Homo sapiens
tgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 15020 - DNA, 2803 bp, Homo sapiens
cccggctctgcccgcccttcgaaagtccagggtccctgcccgctaggactgaggggctttttctctctgtgccccaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagtgagagccccccacccacccaccccacccctgcctcacccaagtctaggctgttcttcccacctctgttctgagccgctatatgacagccccagcaacacactgggccaccctggatgggagccgtgttcattaccctttatttatgtctctccatcatcactccttggaaagcggctccaggttctcacccatatccagccccagaatgacctgaagtcagacaaacctggctttctaatctctgcagctttgtacaggtcacgtaacctttctgagccttggtttcattggttgggagtctaggatgggccaggagctgggacagagcctagaatgtgacaggcagggtgtgatgaggtgtgaggagggcagcacggagcactgtggatggtcagaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtgg

SEQ ID NO: 15021 - DNA, 5432 bp, Homo sapiens
cacacaggaaggagccgagtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacctcagcctcccaaagtgttggaataataggcatgagccactgcacccaggcttttttttttttaaatttattattattatttttaagagacaggatcttgctacgttgcccaggctggtcttgaactcctgggctacagtgatcctcctgccttatcctcctaaatagctgggactacagcacctagttttgagtttcctgtcttatttccaatggggacattcatgtagctttttttttttttttttttttgagacggagtctcgctctgtcgcccaggctggagtacagtggcgcaatctaggctcactgcaagctccgcctcctgggttcacaccattctctcgcctcagcctcccaagtagctgggactacaggcgcccgccaccacacccggctaattttttgtatttttagtagagacggggtttcaccttgttagccaggatggtttccatctcctgacctcgtgatctgcccgtctcggcctcccaaagtgctgggattacaggcatgagccactgcgcccggccctcatgtagctttaaatgtatgatctgacttctgctccccgatctctgtttctctggaggaagccaaggacaagagcagttgctgtggctgggactctgccttttaggggagcccgtgtatctctttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtgg

SEQ ID NO: 15022 - DNA, 3996 bp, Homo sapiens
ttctctctgtgccccaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacc

SEQ ID NO: 15023 - DNA, 3612 bp, Homo sapiens
cgagtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctgagtctctgtactgagaagaaaggctagagtgtgaggccgatgaggatcctggcccccacttggctactctctcactgtgtggcaagtcagagcactttcagagcctcagtttacccttttccaaaatgagaatagtaatgccttatagggtgagggaagattagactcctgaacacctgtgcctatgagggctcagctcaaagccgagcacacagtcgatgctccataaatggtggtgacgtt

SEQ ID NO: 15024 - DNA, 2855 bp, Homo sapiens
atcttccgggagcgtggctaggggcggagcgactgccgcgcgatagtcagggagctgtgcgggtcctggttgcaagagagtctatttgccagccaaccccagcccgggaggggatcagggccaccaggttgctggtaaggatgaaagactgagtgtgttaagactgttgaagtgagcctgtgtaagagaaggaaggattttgtggattgctacattgtgagtgtggggtgagtcccagaacctcgctatgtcagggaaacggaagcgtgtggtgttgactattaaagataagcttgatataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttaatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagtttttttttttttttttttagtgtttttactgcatactcacaaatgttgtctataatttgaaaaatattgtcatatctggccctttgatgagaaaaggaaattacaataataaagttttatgattttaaataa

SEQ ID NO: 15025 - DNA, 3570 bp, Homo sapiens
atcttccgggagcgtggctaggggcggagcgactgccgcgcgatagtcagggagctgtgcgggtcctggttgcaagagaggtggggagaggggcctggcgggttttgagggactgggaggactgtcccggctaaagctggcgcgggaaactggggctgcgcggcgggagggccctgctgctggggaaggaatctaatatatccgttcccctgaggaagggtgccagtccttgactcctaggctcttcggctctctgtcgtaactttggggtgtggcaggggttagtgacgcgcggttacccgggatctggacgtgcaggaggttcgtggccacaatgggggtatagtctttctcacggctgctggggtaataaaacacatgcttttaatccggattatccgcggtgacatggggcctccgctactgcccgtataagttaaagaaaggcctgttctctcaaacttcctcctctttcaccttcttctgcagtctatttgccagccaaccccagcccgggaggggatcagggccaccaggttgctggtaaggatgaaagactgagtgtgttaagactgttgaagtgagcctgtgtaagagaaggaaggattttgtggattgctacattgtgagtgtggggtgagtcccagaacctcgctatgtcagggaaacggaagcgtgtggtgttgactattaaagataagcttgatataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttaatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagtttttttttttttttttttagtgtttttactgcatactcacaaatgttgtctataatttgaaaaatattgtcatatctggccctttgatgagaaaaggaaattacaataataaagttttatgattttaaataagtcatatgtttgtatcctgttttatgaagaaagcagaaataattactgaaagtgccagacactaaggaatattattgtttattattttaatacatataaaaagggattaatctgctaaaatgtaatctaaatcagaattttgataaattttttttgtaaactaagtatgtttattcaagacattgaaactactttgcacatatgaatattaatgtaacttgtaatttaaaagtaaagtgtttccatgctatttcatgttttggccaaaaatttttaaaaaataaattacaattgttctctattagt

SEQ ID NO: 15026 - DNA, 2462 bp, Homo sapiens
gtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgtt

SEQ ID NO: 15027 - DNA, 1883 bp, Homo sapiens
aggcactgcgtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgtt

SEQ ID NO: 15028 - DNA, 2521 bp, Homo sapiens
agtgcgcctgcgcgggttttatactctgctatatgtgtgtccgctgcttttaggcaaccagccgctgcccctgggccgcaaggcaggctggaaacgattccgccgtcaggtcccaaatatgagccgcgagaaatgcagccccggggaaggcgctgaggagggaagggggtctgaggcctcggggctcaaggccagtgcggggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgtt

SEQ ID NO: 15029 - DNA, 1447 bp, Homo sapiens
aactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccatta

SEQ ID NO: 15030 - DNA, 1220 bp, Homo sapiens
gggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagaggattagggacacttgtggaggccgggctcacccctga

SEQ ID NO: 15031 - DNA, 1603 bp, Homo sapiens
agcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 15032 - DNA, 5298 bp, Homo sapiens
gaagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcagctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcagggatgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttgg

SEQ ID NO: 15033 - DNA, 1287 bp, Homo sapiens
gcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaa

SEQ ID NO: 15034 - DNA, 1040 bp, Homo sapiens
accgaacgcccccgggaacaccgggccccgagctcggtcccgcgcccgaggatcctccacggggctagatggctgcgtcgggggcgggagcggaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggt

SEQ ID NO: 15035 - DNA, 1216 bp, Homo sapiens
ctataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggt

SEQ ID NO: 15036 - DNA, 520 bp, Homo sapiens
aataggcaactccggccttccctgccctgacctggaacctctgggagggctgcagatatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccata

SEQ ID NO: 15037 - DNA, 1870 bp, Homo sapiens
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggc

SEQ ID NO: 15038 - DNA, 9094 bp, Homo sapiens
acgtccctcgtggagccgccgacgtcagcagtcgaatggcaacattgtggcgatgctgaggcgcagagtttaggagacgggttcatcagtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaatt

SEQ ID NO: 15039 - DNA, 9042 bp, Homo sapiens
agtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaa

SEQ ID NO: 15040 - DNA, 3200 bp, Homo sapiens
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 15041 - DNA, 3298 bp, Homo sapiens
catgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 15042 - DNA, 3497 bp, Homo sapiens
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 15043 - DNA, 915 bp, Homo sapiens
cccaggggacctcagaagctgctagaagccctgagtgccttctcttgcccctgggagagttgggtcagggcagcaagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgct

SEQ ID NO: 15044 - DNA, 949 bp, Homo sapiens
tgagttgctgccttggccagagtccggagcagccgccgcccgaccacgccgagctcagttcgctgtccgcgccggctcccaccccggcccgaccccgacccggcccggtcaggccccatactcagcctctgacctctgcaggtcagttcccaggacagtggagccaaacacagaccaagcgggaagttcacctccctggtacaaagttcggccctgctactcattaaccttcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcag

SEQ ID NO: 15045 - DNA, 1029 bp, Homo sapiens
ctagagccgactggcagtccccggggccaatggcaagcggataaacagaggcggccgtggaagaggactggaggcgaggctccgcccctccacgggacagtcaggcgagatagccagtgagctcgcaccagaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggc

SEQ ID NO: 15046 - DNA, 586 bp, Homo sapiens
catgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcaggcctctgacctctgcaggtcagttcccaggacagtggagccaaacacagaccaagcgggaagttcacctccctggtacaaagttcggccctgctactcattaaccttcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcggga

SEQ ID NO: 15047 - DNA, 1069 bp, Homo sapiens
tgtgggggccgagcgcacattttcccagcgactctggccccacctgccgagcaggtgagcgcacggagtccagaggccctgccctccagctcccagagcctcgtcgatactacctgcggcgcctccctccacgccggtgggagcccggctctggcttcttcagcggagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacgg

SEQ ID NO: 15048 - DNA, 1930 bp, Homo sapiens
atggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctatg

SEQ ID NO: 15049 - DNA, 1693 bp, Homo sapiens
acgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaagtaaatatatgttcatgaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtc

SEQ ID NO: 15050 - DNA, 1677 bp, Homo sapiens
agacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcatt

SEQ ID NO: 15051 - DNA, 4337 bp, Homo sapiens
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacactaataaaaata

SEQ ID NO: 15052 - DNA, 1757 bp, Homo sapiens
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattc

SEQ ID NO: 15053 - DNA, 3912 bp, Homo sapiens
tagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaacattgcttcattctttgttatttgctcttacgttgggtttgtctcttcttcctagcatttcagtggttaggcatgcacactaaaaatgctatcaatcacccatccaccagggaagtcagtgctgggcaggaggtcagcctgtgtgctcaagagcagtgctgcgcctctccgccaccgagcccacctgtgttgcggttcccacttgggatggcagtgggcagatctcagtggcatcccatcccccaaa

SEQ ID NO: 15054 - DNA, 3363 bp, Homo sapiens
agcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcaggtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccc

SEQ ID NO: 15055 - DNA, 3652 bp, Homo sapiens
tagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttc

SEQ ID NO: 15056 - DNA, 4378 bp, Homo sapiens
gtccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagtgaagtcctgacaactagtggtgtgttagcccacagttctctgcagtggtgccgtcagccctttaaatggcccaccccaggcagactcagacacagggaaggaggcttggaattaggatgggatcgcgagagagatgaaacttggaaaattcagccagaggacctgttcggttcccctgggagtgctttgtggctttggggtcctctgggagctgaagcacacggccatgttggagagcaaaacttaataataattcttttttaaaatctgctgaagcagccccatccggcgaagttcttggcattggctactccatctgtcctagcagagtgtgactaaactggaaatgtatggagctgcattttttttttttttttgatggaagtcaacagctgccttactattttaccatctgacgtttttagtagggagctggggaaacgactgcccgaggaatgcggtcggaggattgtgttgctgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttttttttttttacaccatattagctaccttttcaatggagaagagacagttcacacaattccctggttagcacagatgtggactgagtgctttgtcacctgcagggtagtaacccagtgatgtttcttacagaagcacaatatgttgaaaatcctgggtgtgaccaatatggaataaagaagaaggcagaaagagagcaaatgaaaaatttcaacttgtatattcattttttacattttgctttgacttttaaatttaggaagtccgtttttacctgagaacaaatgtttaaagttcctgcgtcactctcagtactctcactgcccctcccaaaccctatagctccttacgctgggaaagctggttttttaaaaaaataataataaaatatttaatcttattaagtgttcatttaaaatgcgtaatgctttggaaataatgggtaacagatagcgagaggatatgtttataaagtgagcatgttggtcccatttataaatatatgtatgatttataagcttttttaaaacaaagctcaaattgttggtatttttctaaaatgtgcacagctgtattttacatgaaggctctttctaatgggttgttatactgtactcaacattttggacagcacatgaagtctgccaatgtacttaataaaacatgactttgtttatttaaagtttcttgctgtgaaaaagaactccctacctgtgagttcctttatttataattcttgaaaccaaaatgtataatgtacagttttcacaactgtatctgctctaataaaaaaaagttggttattaatgaa

SEQ ID NO: 15057 - DNA, 1923 bp, Homo sapiens
ctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggatgtgttaaaatcgccctcagaatatggtcgagacaatgaaacaagacaatgaagcactgagcatcatgcctggcacataggaaatgccaaaatatatattcccgtatttccttcacattccaaagggtgaattaattcaggatggcctgaaccatagctgtcactgtcttcgggaggatatttgaggacaaaaacgagtttttgactttggaacagtaaataagacaagactttgattcgcttagttctgccttgagtcctgccagtgtagatggaatccatgccagacatgattccatttcgaatgtagaatcagcataatttaacctcatcttggaaatctcatgtcccagttcacagccaggcatcagcgtgacagtcagctgagctgctgtcttggcagcttctgggcattctatggagaccccaggagagcacagcagacccttagcagaacagaaaagcggaccgtattagtctttcctgtccacggccttgttttcagtgattcatgtgcccgattggccaaatctctgcagacgtgcccctgtccgaggccaggcttctgggattcatcgagcttgcttgtttccgggacctgctaattccgtgcccagcagctgttccccggagcaggccctgccctccacaccctcatgaggaatgccgagtctcattttctgagggccctggttgagggtggggtgtggggcgagggggacagggttgcttcctgccatagacttcctgccttggagggttatccttgttctcacctatcccttcccgagctgaagccacagagtaggagagaagttagggctggcacacctccctcccgtgtaactttcactccctgcttaaagggaactgatgagagttgcctggcacagatctgtgcctggcagaatccacagagcagcccaggtgtgctaggaactccagagtgacccctgctccaggccaggaatgagcaccttgtgcctggaggtcttcctgccactgctggctgcccattgctgtggatggggtagagctggagtcacacatggaggctggacagctgcatgcagcctgcaggggacactctggatggcatgtaccatgtttttattatttctatttttaattaaattggaatcctttatggata

SEQ ID NO: 15058 - DNA, 4787 bp, Homo sapiens
ggattttcagtgttccaggactgggtgttctgctggtctccctctcccctcccttccccgattccccggtgccctccctgcgcgcagacccaggggactctgagaatggaagggagctctcattcccgggaggaaaagacaccaggttccctgggctgcctgcactcagttctcagcctccttcctcatgcctccagccactgcccgggtctgcggcacgggcgcgatttgaaatacccctccttcccgctttgaagaaggctgggctggctgggggttattttgggagcagcttctgagatccaatggccttgttagggcaacactgacctttccgtcccagaaggagggcaggattggagaagggggcggggcagcggcggggagaccgacagccccgcacacccactggggtggagaagggggccagcgggctgcgggaattcagcctccggcgggggctgccaccgaggggaatttcccctctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggacgtaccaaggccagttcaccaacggcatgcgccatggctacggagtacgccagagcgtgccctacgggatggccgtggtggtgcgctcgccgctgcgcacgtcgctgtcgtccctgcgcagcgagcacagcaacggcacggtggccccggactctcccgcctcgccggcctccgacggccccgcgctgccctcgcccgccatcccgcgtggcggcttcgcgctcagcctcctggccaatgccgaggcggccgcgcgggcgcccaagggcggcggcctcttccagcggggcgcgctgctgggcaagctgcggcgcgcagagtcgcgcacgtccgtgggtagccagcgcagccgtgtcagcttccttaagagcgacctcagctcgggcgccagcgacgccgcgtccaccgccagcctgggagaggccgccgagggcgccgacgaggccgcacccttcgaggccgatatcgacgccaccaccaccgagacctacatgggcgagtggaagaacgacaaacgctcgggcttcggcgtgagcgaacgctccagtggcctccgctacgagggcgagtggctggacaacctgcgccacggctatggctgcaccacgctgcccgacggccaccgcgaggagggcaagtaccgccacaacgtgctggtcaaggacaccaagcgccgcatgctgcagctcaagagcaacaaggtccgccagaaagtggagcacagtgtggagggtgcccagcgcgccgctgctatcgcgcgccagaaggccgagattgccgcctccaggacaagccacgccaaggccaaagctgaggcagcggaacaggccgccctggctgccaaccaggagtccaacattgctcgcactttggccagggagctggctccggacttctaccagccaggtccggaatatcagaagcgccggctgctgcaggagatcctggagaactcggagagcctgctggagccccccgaccggggcgccggcgcagcgggcctcccacagccgccccgcgagagcccgcagctgcacgagcgtgagacccctcggcccgagggtggctccccgtcaccggccgggacgcccccgcagcccaagcggcccaggcccggggtgtccaaggacggcctgctgagcccaggcgcctggaacggcgagcccagcggtgagggcagccggtcagtcactccgtccgagggcgcgggccgccgcagccccgcgcgtccagccaccgagcgcatggccatcgaggctctgcaggcaccgcctgcgccgtcgcgggagccggaggtggcgctttaccagggctaccacagctatgctgtgcgcaccacgccgcccgagcccccaccctttgaggaccagcccgagcccgaggtctccgggtccgagtccgcgccctcgtccccggccaccgccccgctgcaggcccccacgctccgaggccccgagcctgcacgcgagacccccgccaagctggagcccaagcccatcatccccaaagccgagcccagggccaaggcccgcaagactgaggctcgagggctgaccaaggcgggggccaagaagaaggcgcggaaggaggccgcactggcggcagaggcggaggtggaggtggaagaggtccccaacaccatcctcatctgcatggtgatcctgctgaacatcggcctggccatcctctttgttcacctcctgacctgaccgtcgcttaccagagccagaagttcctgctgaggacatgaggacccgtctttttgcagtgccaggcagggtggccaaagaggactggactctggacctggagccccgtggtccagttcacattcaccccacaagagtttcaggaggcctcccacggtgcctgtgctgggtggcggtggtggtgccaagaggaatggaatgtcctgggctccttcaggagctctctacccaggggcaaggagagcccagagagaagcgccctggtctcttgagcttcctgatctgctcctgtcccccgctctcctccactcccttgcctttccctaggttgtcccctccctgggcttttgtgtgttttgggagatgtcacctaaccaggacattgatattcaatcccatcccccttcctcccaccctgccccactttgatttaatcctttggctgtgggctgaggcctcccagggaagctgggtggggtgggtgttgagaccccctcagaccagcacagagacctgtccttgtgcagtctgcaccctgcactccctcccttgcctgtagatgttctggatgacagtagaggaaatggacaaggtcagtttgaatatcccagaacacagtgctctgtctcctcccaccagtccagttagcttcccttctggaccaatagacgaggggagaccccatggatcctctggctgggaagccactgaccaggtggccagggggcagggtgggaagaggggttaaggtgcagtgatgatggcctgttttggagtgtgtctgagactgggattgcatttggggtttcccgtgtgcttgggatgctagagggtcacctgcaggaggcctggggccggcgagaaatctcctgtgatgccctgtgaaatggcttgtctcctcccccatcagggcccaccgaaagctcaggggagcacagaagcccatggaagcccagggagatgtccctggggcagacactaaggcaggtgttgaagacaagctgcttgtcaagaagcatttcccggcaagagaggggcaagtctggggctccaactgggtacagcctgggtgcagttataagcccctttggcttacttggtagaagatggctacttggatgtacctcacttaaagatgttttgtaccacactaggtctctgggcccttgtgcttcctgtgggtggggtgagggccaaaggctatggtttcctgcctccaggagaatggagagaaagggcttccaggcccctccaagcctggggaaggacgtggcatccaagctgagccagagggaactgctgctgtcctcccttcatttctgtggaccttggaggctttggctttgtggcagggcctccccaggcagctctgggacctaggagtttgcttctgatagggtcagctttcccatttcccttcaatgcttgggaaccttctcccttagcttcacacttgccgtttcaagccctgctgggaccttgtggcttggctggaatccaggactgtattttcatggagaagaacctgcagattcttccatcctcagctggccatggcccacagctctgcatctgcatctgagcttctcaagactcctggagcatgaggggaatggggcggggccactgctctgtgctgacgggctccgtctcggagattcttgtcctgttttttttctgttgtttttttttggctggtgctggggacaagcctgtgcctgccaaagctcccaggccaagtttgggggctggtgtttggggttgggtttggggttcaggatgctgcagtctgtgcaataataaacccgcatctgctcacgggc

SEQ ID NO: 15059 - DNA, 3985 bp, Homo sapiens
agcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaa

SEQ ID NO: 15060 - DNA, 815 bp, Homo sapiens
gtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctga

SEQ ID NO: 15061 - DNA, 93 bp, Homo sapiens
atgccaccgcattcggggcagagccggggccggaagccagggagctgcctgctgctgctgctgctgctgctgctgctgctgctgctgctgctg

SEQ ID NO: 15062 - DNA, 2191 bp, Homo sapiens
ggaattcgggtgactttgctccaagatacacgcgtgtgtcccgactctcactcaatttataggggagagggactcgccaaatccctgttttctgggggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattggggtcgctccatcacccaaacaaaagaacaaggtttgccaggatgtccgagtgccccctggccctggctctcgtgtgcatggacgtgcc

SEQ ID NO: 15063 - DNA, 3109 bp, Homo sapiens
ccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaaattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgtga

SEQ ID NO: 15064 - DNA, 2296 bp, Homo sapiens
agaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgc

SEQ ID NO: 15065 - DNA, 2059 bp, Homo sapiens
acgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcca

SEQ ID NO: 15066 - DNA, 2237 bp, Homo sapiens
agcttcgcacccggtgggcgtcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcca

SEQ ID NO: 15067 - DNA, 1697 bp, Homo sapiens
ggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcag

SEQ ID NO: 15068 - DNA, 8287 bp, Homo sapiens
gacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 15069 - DNA, 7560 bp, Homo sapiens
gataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacagatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 15070 - DNA, 5892 bp, Homo sapiens
acaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaa

SEQ ID NO: 15071 - DNA, 7106 bp, Homo sapiens
agtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccattttt

SEQ ID NO: 15072 - DNA, 6944 bp, Homo sapiens
ggcaaaggacgaggcggaggctgaggaaggcagcggggagacccaggctgcagcaacaaagggcagcgagcgattggccgggctgcaggcgaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccattttta

SEQ ID NO: 15073 - DNA, 6537 bp, Homo sapiens
gtgtgggaggactggtggctgtctttgcaggcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagca

SEQ ID NO: 15074 - DNA, 5752 bp, Homo sapiens
gtggctcccagtaagtcagagctgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcca

SEQ ID NO: 15075 - DNA, 10806 bp, Homo sapiens
gcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaagctctctggtggatgtgagctgacagtggtcctccaggacttcagtgcgggccacagcagtgagctgaccatccaggtggggcagacggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcc

SEQ ID NO: 15076 - DNA, 5492 bp, Homo sapiens
atgaagggcggcgacagggcttacacccgaggtccctctttggggtggctctttgctaagtgctgctgttgcttcccgtgtagagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcc

SEQ ID NO: 15077 - DNA, 6509 bp, Homo sapiens
gtgtgggaggactggtggctgtctttgcaggcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagc

SEQ ID NO: 15078 - DNA, 874 bp, Homo sapiens
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 15079 - DNA, 1854 bp, Homo sapiens
agttcctccacctgctggcccctggacacctctgtcaccatgtggttcctggttctgtgcctcgccctgtccctgggggggactgctctggttttctggaaccccaccccaaggatcctgaatgccttctcagccagcgcttctgccctggcctcccccaagattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcagattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtccagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccctttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 15080 - DNA, 2363 bp, Homo sapiens
ctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatca

SEQ ID NO: 15081 - DNA, 2173 bp, Homo sapiens
agaacagcttgaagaccgttcatttttaagtgacaagagactcacctccaagaagcaattgtgttttcagattacagagggagttttctctgtgtccccacaaggcatgattctgggtctatggtgacttaagagggccacacaacaatgagtatttaattttcctcagatgtatggctacaataaacatctataggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatc

SEQ ID NO: 15082 - DNA, 645 bp, Homo sapiens
tggtgggctgtctgttggggtctatgcacaggatttctgctggagttctaaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccag

SEQ ID NO: 15083 - DNA, 1191 bp, Homo sapiens
ggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 15084 - DNA, 1273 bp, Homo sapiens
ctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 15085 - DNA, 1266 bp, Homo sapiens
ggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 15086 - DNA, 1179 bp, Homo sapiens
aacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 15087 - DNA, 1347 bp, Homo sapiens
agtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 15088 - DNA, 882 bp, Homo sapiens
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaa

SEQ ID NO: 15089 - DNA, 1170 bp, Homo sapiens
gggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcaggggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagtgtgcaatagtctggaataaatataaatgaaggaggg

SEQ ID NO: 15090 - DNA, 1074 bp, Homo sapiens
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 15091 - DNA, 1077 bp, Homo sapiens
caagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 15092 - DNA, 735 bp, Homo sapiens
cgaggacaggccaaacagtgacagccacgtagaggatctggcagacaaagagacaagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagt

SEQ ID NO: 15093 - DNA, 1258 bp, Homo sapiens
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 15094 - DNA, 378 bp, Homo sapiens
atgtggcccctggccctagtgatcgcctccctgaccttggccttgtcaggagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataa

SEQ ID NO: 15095 - DNA, 1239 bp, Homo sapiens
cagctcagagctcttcctgcttgtccctgggtgacctggtttcccggctgaggttggccctccgaccccagacccttcacctcccaaaataccctcgcagcagcccctcccgcgttcaaggcttcctgtcctctctggaaagctgaaagacatgggttcgcgtcctgacgctgccgctttgagccagtagcctagcagctgctttgtgcctaaattgttttcatctggaaaatgggcttaatctataagtgcttaccagagaaggtcactgtgaatattgaaacgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 15096 - DNA, 1614 bp, Homo sapiens
tcaggccccgcccgccctgccctcccctcccgatcccggagccatgtggcccctggccctagtgatcgcctccctgaccttggccttgtcaggaggtgaagacttcaaggagccaagccaggggcctagagatgtaatggcggcttcccgaccagaggccttcccaaagggcttgacccttgagccaagacctgaaaaaggagggatctgtgggtgcctggcacctggcaccatccttggcctgaaggtggggtggcttttctcctctggcgacactccctggattcatgcccgtgccactcctgagtgccacaccctaggctaggagacccacacgctacgccttgtggagtcctcaacaacctggcgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 15097 - DNA, 927 bp, Homo sapiens
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacat

SEQ ID NO: 15098 - DNA, 1060 bp, Homo sapiens
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacgagcagttgcttcaggcgttttctccc

SEQ ID NO: 15099 - DNA, 1133 bp, Homo sapiens
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccagg

SEQ ID NO: 15100 - DNA, 1282 bp, Homo sapiens
ccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccaggcccccagcccctcctccctcagacccgggagtccaggcccccagcccctcctccctcagacccaggaccccagtccccagcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccgaataaataatgacaataaaaatggaatcatcctaaattgta

SEQ ID NO: 15101 - DNA, 1172 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 15102 - DNA, 1309 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 15103 - DNA, 1054 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 15104 - DNA, 1261 bp, Homo sapiens
atgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 15105 - DNA, 855 bp, Homo sapiens
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctgg

SEQ ID NO: 15106 - DNA, 2834 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctt

SEQ ID NO: 15107 - DNA, 2871 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctt

SEQ ID NO: 15108 - DNA, 892 bp, Homo sapiens
aaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtc

SEQ ID NO: 15109 - DNA, 1464 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 15110 - DNA, 834 bp, Homo sapiens
cacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagacc

SEQ ID NO: 15111 - DNA, 1906 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 15112 - DNA, 1335 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 15113 - DNA, 555 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagt

SEQ ID NO: 15114 - DNA, 1347 bp, Homo sapiens
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcacgaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgc

SEQ ID NO: 15115 - DNA, 481 bp, Homo sapiens
atggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 15116 - DNA, 1510 bp, Homo sapiens
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 15117 - DNA, 1526 bp, Homo sapiens
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 15118 - DNA, 376 bp, Homo sapiens
caggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgaca

SEQ ID NO: 15119 - DNA, 1478 bp, Homo sapiens
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 15120 - DNA, 134 bp, Homo sapiens
caggagcggccatgaagaagctgatggtggtgctgagtctgattgctgcaggaatcttcaggtcttcctggggaagcataaccttcggcaaagggagagttcccaggagcagagttctgttgtccgggctgtga

SEQ ID NO: 15121 - DNA, 429 bp, Homo sapiens
atgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgaca

SEQ ID NO: 15122 - DNA, 1013 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 15123 - DNA, 456 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 15124 - DNA, 590 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 15125 - DNA, 1148 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 15126 - DNA, 1324 bp, Homo sapiens
cgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctatgttccagttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 15127 - DNA, 1438 bp, Homo sapiens
catggaggaggaaggagatggcatggcttaccataaagaagcactggacgccgggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctca

SEQ ID NO: 15128 - DNA, 1602 bp, Homo sapiens
ggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctaacctcaccatgggacgcccccgacctcgtgcggccaagacgtggatgttcctgctcttgctggggggagcctgggcaggacactccagggcacaggaggacaaggtgctggg

SEQ ID NO: 15129 - DNA, 683 bp, Homo sapiens
catggaggaggaaggagatggcatggcttaccataaagaagcactggacgccgggtgcacgttccaggatccaggtgcccaggggtcatgaagctgggactcctctgtgctctgctctctctgctggcaggtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactga

SEQ ID NO: 15130 - DNA, 6314 bp, Homo sapiens
gtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctgttggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagatcctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagtgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcgtagctcaccaatggtgagtaaagatacagctcttttaaaggtcataaggataatatattttccccatcaatgctgattctgagaaaagagcaatttatcaaaattaaacactgtaaaagaaaggtgtccatatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcactgcagctcctgtcacaagctgggatggatttatcacattgagttatgaaattacctggttctaagaatttttgagtggcaaaaatagaaaacaatcttcatttgaaaacatccctaagcttgaataaatggataccatagatagcttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccaga

SEQ ID NO: 15131 - DNA, 4195 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttgg

SEQ ID NO: 15132 - DNA, 3168 bp, Homo sapiens
gttgccgggcacctcccgccttcccgcgccccgaccccgaactcctctccttagttctcccgggcaccctatcctatcaacgcctactatcccagccaatcgcgcaggatccgagtcgtgcctccggtccaccctcctcccagcgctcagccggtctgagctcaaggcctttaccaagcccacccaatcaacggcgggctctctcctaccccatcccaatctccctcccctcggccaatccgcgcgctccattccgctgcccgcccagccaacccgggccttgaaaccagcaggcgaatgggcgcgagacggcccttcgacgctgagcgcctggccagttagggattccgcgtggccaggacaacggccaatcgtcgtggagcgcggcgcctccgcggagagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcataaaataaccatttgg

SEQ ID NO: 15133 - DNA, 2347 bp, Homo sapiens
tgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcagacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttattt

SEQ ID NO: 15134 - DNA, 2989 bp, Homo sapiens
atttaaggggtccggagaaaatgaagctaagtccgctagagactggtcctttgtataaaaatgtgggatggattggttgaaacagcctagatgccagttaagtttctctttggtgtccatctcctgttgggggatggggtcagagggaaggattggatgatgcttgacatctttgagaaagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttattt

SEQ ID NO: 15135 - DNA, 6830 bp, Homo sapiens
gccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctggagtcaaggggtttttctttctcgctagttttgtgaaaatttttatatcaataggcaaatcattataactttttaggggttgatggtttttaagtatattggaaattgtggtgtctaaggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggttttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaata

SEQ ID NO: 15136 - DNA, 1062 bp, Homo sapiens
gcaggcgcactgcgaacgccggctgagctgagtctcgctgctcggtgcgaggcggcggagagcgaggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatat

SEQ ID NO: 15137 - DNA, 727 bp, Homo sapiens
ggagccctggtgtgatcgccatcgggaacgccggtcgaggctaggcggggcggggcggcgtggcgcggcggcggggctaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccc

SEQ ID NO: 15138 - DNA, 596 bp, Homo sapiens
gctcggtgcgaggcggcggagagcgaggcctggtgagcaccgccgaggcgcgggccagctcttcgagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcat

SEQ ID NO: 15139 - DNA, 4470 bp, Homo sapiens
gccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctcccccggcgctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccgccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaa

SEQ ID NO: 15140 - DNA, 8981 bp, Homo sapiens
gcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacattgagaccacctcaagtgctgtaaaaataagaatgttatattaggggtgtgtgagacgccctagtctaaaatctatctttaaatatatttcctttgtaattttcaaagacttcagtaattgtgtgttatggtggaaataatactttccattggtccacattgctctggaccaaacctggagcatttctataattagagctatctatgaatcattaaaaatggatctagaataattttggggagagggagtgtatcatttagtttaggcttacctcagcagcacttcatagggtgaggagttgtttgtttctttaaaggtataactgcattgtaaaatgactgggtttattgtaacagtaatttatgggggcaccctttttggattctccattgcctcagtttcctcaaggaaaaagttacagagattaagctaaattttgaatttagagaataactgctgtgtaattttggtataattaccataaatttagtgtcttaaaacacaacatacattatttcacaatttctgtaggtcaagagtgtagttaggttttctgctcagggtctcacaaggctgcaataaaggtgtcagccagagctgcagtcttatctgaagctagggggtcctcttttatgcacatatggcaaaatccattgcctagcaactgaagaaatcatgggaacttcttcaaggccagcaagagaatctctgatctcagggaaggccttaagcgcttttttaaaggtctcacctgattagatcaggccacctacccaccagggtgatctcccttttgattaacccaaagccaaactgatgaggtaccttcattacccctgcaaaatcccttcacctttgccctgcattgtagtccaatcacaggggtgatacgcatcatattcaaagatcctgttcacagtcaagggagggggttatatggagtatgtataccagggaatcttgggagccatcttaagagttcttcctatgacaaggactcaactatttagaactggaacaatttacaagtgatagccttatatagttatcatagcaagcttatttggggatcaaggttgcctctgagaacctaatgaaaactggaccagcttccccaaaaagtgtatatacatggtagtttttcatacagttttaggggattcataagagtccatgaattacagtctgtcccaacccttccctttagatgatgagttgttgaggtgacttgcccaaggtcacacagctactaagggccaaataaagcccacatctcaactcccatactgcccagggcttctaattactattctaaaggtaatctaaattcatttaaatttgtgaaccaatgcaaaaaaatgtgaatgtagctttttggatattttttttgtttactaaggaatgggtaacattgttatagaagcttgcctaagagttttgaaattagttgacctttttgagtttccaaaattgaatcttccattgtagctattaaagtgaactataaataggccaactttaattgttaactcctcgggtttggtggattatctaccatttatatataaaatttcagttagaatccaccattggcgttttgaaggccaagatagctgagtatcttatcctttttgtaacttcttgattattttacttattggcaaaattcattaactgtcagccaataatttaatattatgggaggaaaaaattttgcccagatatctgaggcaatactcccaaacactaacaaactgatgcctaacaaacttgacattttgaacacttaaagttttccctaaactttttaataagcacattaataaagtatgcttttaaatatatatgtacaataatttttaaaagttgctgcaagatgccttcaaatcaatatgcacgttggtggcattagtgcagtcttctatttttatttttttgagacacagtctcgctctgtggcccaggctggagtgtagtggcgcaatctcggctcactgcaacctctgcctcaagggttcaagcaattctgcctcagcctcctgagtagctgggattacaggagtacgctaccacgcctggctaatttttgtatttttagtagaaatggggtttcaccgtattggccaggctggtattggaatcctgaccgcaaatgatctgcccacctcggcttcccaaagtgctgggattacaggcgtgagccactgcgcccaaccagccttaattcttaataaaggaagttgaaaaataatgaacattggtaaaactattctagtgtgatcagaagcaaatttggactgtagtgtcaaattgataaaaaactaagcacaccaatcatgtataagaaaagtagatttaacatttttttccctaaacacttaacccagaagttaacaataatcttgaaaattccttttaaatccaggccctttaggtgatggcagtttgactcaggatgtccaagtccagtgtattttcaataaaattgacttgacagctactgctctgggtgtaagagcagttgactgtgaggaaaagtaaatggttctacagattctttatgatctacctcccaccagaggactgcagtactcccttgttatttatattttctgccccaatttttgccttctccacaaattttataccttttgtagctgcctactccagattacttcacctttccagactatcagttcttccacttttattcttcataaagaaaattccaataacctgtttcacttaggtttttctattactcttcaagcatgaatcctaatttccctgactatatcttacctctgatctccataactgatggattcctatcctagactatgttactctaatattacccaagattttctccagcctgtttttactcttactttgaaacagctgtttaaaatgactcgtaatctgcttaaatctacatgctttttgtggttctcaatccagttacctaccttccagataattccctcactgtcctgtcctctccattcctctgatgtttaagccctgtgagccacctttcccccatcctttgtgcatagttaccattttactctttcttgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatgatgcaatttctca

SEQ ID NO: 15141 - DNA, 1725 bp, Homo sapiens
tgctgtccaacctgcaggtaacttactacttccagtcaatatgccgaccttagatgctccagaagagaggcggagaaaatttaagtaccgaggcaaagatgtgtctctgaggcgacagcagaggatggcggtcagtctggagctccgaaaggccaagaaagatgaacagaccttaaagagaaggaatatcacgagcttctgccctgacacaccttctgaaaaaacagccaaaggggtggcggtcagcctcactctgggtgaaataatcaaaggtgtgaatagctcagatccagtcctatgtttccaggccacccagacagccaggaaaatgctatcccaggaaaagaacccccctctgaaactggtcattgaagcgggcctcattcccaggatggtggagttcctgaagtcatcactttacccctgcttgcagtttgaggctgcctgggccctgaccaacatcgcttcagggacttcggagcagactcgtgccgtggtagaagggggagccatccagcccttgattgagctcctgtcttcctccaacgtggctgtgtgtgaacaggcagtgtgggctcttggtaatatagccggtgatggcccagagttcagagataacgtcatcacaagcaatgccatcccacatctcctagccttgatttcacccaccctgccgatcacatttctgcggaacatcacgtggaccttgtcgaatctgtgccgaaacaagaacccatacccttgcgacactgcggtgaagcagatactgccggccctccttcacctcctgcagcaccaggacagtgaggttctctcggatgcctgctgggcactgtcctacctcaccgacggctccaacaagcgcatcggccaagtggttaacacgggggtcctgcccaggctggtagtgctcatgaccagctcagaactcaatgtcttgactccttctctccgcaccgtggggaacattgtcacgggcacagatgagcagacgcagatggccattgatgcgggtatgctgaacgtgctcccccagctcctgcaacacaacaagccctccatccagaaggaggcagcctgggccctgagcaacgtagcagcggggccttgtcaccacatccagcagctgcttgcctacgacgtcttgcctcccttggtggctctgctaaaaaacggagaatttaaagtccagaaagaggctgtctggatggtggcgaactttgcaacaggggccaccatggatcagctgatccagctcgtccactctggggtcctggagccactggtgaatctgctcactgccccagatgttaaaattgttctcatcatccttgatgtcatctcttgcatcctccaggcggcagagaaacggtctgagaaggaaaacctgtgtcttctgatagaagaacttggtgggatcgatagaattgaggctttacagctgcatgagaaccgtcaaattggccagtcggctttgaacatcatcgagaagcactttggtgaggaagaagatgagagccaaactttactgagccaagtcatagaccaagattatgaatttatagattatgaatgcttagcaaaaaaatagccaagctccctacctcctaaaccaacaacccagtgctaaaggataacttctttaagaagcagcagtcctctatcttagtgtaacccaaatgtgaagcttttaaaacttgacattaataaaatgttcaacacttt

SEQ ID NO: 15142 - DNA, 5297 bp, Homo sapiens
tcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccgtattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 15143 - DNA, 5108 bp, Homo sapiens
tcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccgtattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccatgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 15144 - DNA, 4911 bp, Homo sapiens
ttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccgtattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 15145 - DNA, 5014 bp, Homo sapiens
cggcgcccaggccggggggctgtttgcaaactgcgcccattttgtggggctgaatccgcccgggctacgctcctccatcacgtgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccgtattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaa

SEQ ID NO: 15146 - DNA, 5105 bp, Homo sapiens
tcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccgtattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaa

SEQ ID NO: 15147 - DNA, 1564 bp, Homo sapiens
gggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctgaaaa

SEQ ID NO: 15148 - DNA, 1684 bp, Homo sapiens
taaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctgaaaa

SEQ ID NO: 15149 - DNA, 1894 bp, Homo sapiens
agagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctg

SEQ ID NO: 15150 - DNA, 716 bp, Homo sapiens
ctgacctcggtgtgtgtgtgagtgtggtgaaaatcaagtgggagggaaagtgagcaagcacctgaacaagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatc

SEQ ID NO: 15151 - DNA, 1138 bp, Homo sapiens
agcgacctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaa

SEQ ID NO: 15152 - DNA, 1465 bp, Homo sapiens
cgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaaccgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataa

SEQ ID NO: 15153 - DNA, 2060 bp, Homo sapiens
cttggctggaacctgagacggattcgctcccaaatgatgctccagtggcaggagcaactcaagttcatcattgtcctgagagagaggagcagcgcggttctcggccgggacagcagaacgccaggggaccctcacctgggcgcgccggggcacgggctttgattgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaaatgtttggcactttgctactttattgcttctttctggcgacagttccagcactcgccgagaccggcggagaaaggcagctgagcccggagaagagcgaaatatggggacccgggctaaaagcagacgtcgtccttcccgcccgctatttctatattcaggcagtggatacatcagggaataaattcacatcttctccaggcgaaaaggtcttccaggtgaaagtctcagcaccagaggagcaattcactagagttggagtccaggttttagaccgaaaagatgggtccttcatagtaagatacagaatgtatgcaagctacaaaaatctgaaggtggaaattaaattccaagggcaacatgtggccaaatccccatatattttaaaagggccggtttaccatgagaactgtgactgtcctctgcaagatagtgcagcctggctacgggagatgaactgccctgaaaccattgctcagattcagagagatctggcacatttccctgctgtggatccagaaaagattgcagtagaaatcccaaaaagatttggacagaggcagagcctatgtcactacaccttaaaggataacaaggtttatatcaagactcatggtgaacatgtaggttttagaattttcatggatgccatactactttctttgactagaaaggtgaagatgccagatgtggagctctttgttaatttgggagactggcctttggaaaaaaagaaatccaattcaaacatccatccgatcttttcctggtgtggctccacagattccaaggatatcgtgatgcctacgtacgatttgactgattctgttctggaaaccatgggccgggtaagtctggatatgatgtccgtgcaagctaacacgggtcctccctgggaaagcaaaaattccactgccgtctggagagggcgagacagccgcaaagagagactcgagctggttaaactcagtagaaaacacccagaactcatagacgctgctttcaccaactttttcttctttaaacacgatgaaaacctgtatggtcccattgtgaaacatatttcattttttgatttcttcaagcataagtatcaaataaatatcgatggcactgtagcagcttatcgcctgccatatttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaagga

SEQ ID NO: 15154 - DNA, 1957 bp, Homo sapiens
agccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgcagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacc

SEQ ID NO: 15155 - DNA, 1930 bp, Homo sapiens
cggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgcagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacct

SEQ ID NO: 15156 - DNA, 2464 bp, Homo sapiens
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggc

SEQ ID NO: 15157 - DNA, 3123 bp, Homo sapiens
atggcacggggtccacagaccctggtgcaggtgtgggtgggcggccagctcttccaagccgaccgcgccctgctggtggagcactgtggcttcttccgaggcctcttccgctccggcatgcgggagacccgcgcagcagaggtgcgcctgggcgttctgagcgcgggaggtttccgcgccacgctgcaggtgctgcgcggcgaccggccggcgctggcggcggaggacgagctgctgcaggccgtggagtgcgccgccttcctccaggcgccggcgctggctcgctttctggagcacaacctcacgtcggacaactgcgcattgctgtgcgacgcggccgccgccttcggcctgcgcgacgtgttccacagtgccgcgctcttcatctgcgacggcgagcgcgagctggcggccgaactggcgctgcctgaggcccgcgcctacgtggcggccctgcggcccagcagctacgcggccgtgagcacgcacacgcccgcgcccggcttcctggaggacgcctcgcgcacgctgtgttacctggacgaggaagaggacgcgtggcgcacgctggctgcgctgcccctggaggccagcacgttgctggccggggtggccacgctgggcaacaagctttacatcgtggggggcgtgcgcggcgccagcaaggaggtggtagagctgggcttctgctacgaccccgacggcggcacgtggcacgagttccccagcccgcaccagccgcgctatgacacagcgctggccggcttcgacggccgcctctacgccatcggcggcgaattccagaggacgcccatcagctccgtggagcgctacgacccagccgcgggctgctggagtttcgtggccgacctgccgcagccggccgccggcgtgccctgcgcccaggcttgtggccgtctcttcgtgtgcctgtggcggccggccgacaccaccgccgtggtggagtacgcagtgcggaccgacgcgtggctgccagtggccgagctgcggcgtccgcagagctatggccactgcatggtggcccaccgcgacagcctctatgtggtgcgcaacggaccttccgacgacttcctgcactgcgccatcgactgtctcaacctggccacgggccagtggacggcgctgcccggccagttcgtcaacagcaagggagcgctcttcacggccgtggtgcgcggtgacaccgtctatacggtcaaccgcatgttcacgctgctctacgccatcgagggcggcacctggcggctgctcagggagaaagccggcttcccgcggcccggctccttgcagacctttctcctaaggctgcctcctggcgctcctgggcctgtgacttcgacaacggcagaactgtgacctctgggctggctttaggagggaggagacgccgcgactcctccctgagctatggctgagtgtgtgaggccggccttagaagtagctggcaacttccctctttctactgagacacccaggtttggtgccttctggtggtgtggacatgttcaagaagctcagggagcagtgatgatgccctcaaattacttgggctctgctgagagctggtgggtcacaatgtcagtgaacagggtagggggagttgggatttgaataatccgggcttatatgtaatgggctagtgattgagcatcgctgggagcgacttaaatgatgttaatcaaactgcaagtagtaggcaagaattaggcacctactgtatgcccaatacagtgttatgcgtaatgagagccgtagttgccacacagggatccaggaagcttaaaggataacccagaaaacaatcttaacagttacaggacaacaaaaaggtttacacacaacttgatccacagagttgaaggcaacatgcaaaaaaatttaaaaccgcatacaatataataaaataaagtgctgaagaaatcagggcaaagggaaaataggaagagaaaaaatatataactccagaaaagaagagagtgtgcaaactctatggaggagatgagcaggataccattagctgctgaaaggggaggcttagaccatggaggctgagagctcagaagagaagcagggttggggaaggctggagcagatggggagggtctctgcaagtccagccataccagcagagcagcagtagttggggcatctagagaggggatgagactgggccagcttgcagcagataatgactgagctgagcctggagtgagacctgtgggggcgagaggattcttcacgttcctttttggaacccttaggggagcacccaggtgtaagcccttgcccaccctgtttttgccatcaccacggggcagtggactgttaacccacatgacttcaggtcagttgaggtatgagccaaatcctgcctcatcttcctcagttgtagcccctcctccacattctacaggtttgttctcttcctgtcctattctgccctttgcaattccctgggctggaatgcctagtctcctcctctctccctgtcagtgctctaccatcctctgtgcagcattggctcacccagctcttcgttttcctgacctgggctgcctgcattgctcattggacccctggctgtaacatcattgtgtgtgcacaaccacgtgtgtggattgtaagggcagagatcctgttaagtgagctgggggacttccctgtcccagattaaaatgatgatgccttgaaagaacccaggctacagaggccactagttaggaacctagtgctgacctctgttgttggatgaggactctcgttccttcatcaaaatccccagctctggcttctgggcagatgcctgtcccagccctttccagcctctccatggccttgggaagacttctctgggtggttctcattggtctccatcccccaggacctgaggcccatggggaatcttggcctcgtcagaagtggagaatgcagtgtcagcatgacacctccggggcatggaggctcgcgccagggctgcacctagctgcctcttctcctggcctatgtcccaaccctggagaatgctgccctcagaagcctgggaccttccagccctggagtagcctagtctgataagtctcaacaataaaccctgacttttgc

SEQ ID NO: 15158 - DNA, 4115 bp, Homo sapiens
gaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaactcttcaagaacaaggatctctgtagcgttacctactgatgttgaaagagttagtagatcaaacagaatagtaggaaacaagaaaacattaaacttatacaggaaaaatgtctggccatatgttagttagttcgggaatggttattggtaatttgttttgtattatagcatacaataactagagttaccaaaggcttgttttttcttgagcagttgaaaggagagaccaatatttgtgacatggatagtttcatgaccacaactcattcaatcattttatagtctatggcaatatccaagagattgccaagagtagaagacagaatatttcatctgacagtatctgattggtttactgtttttctaatcatatgtggtcataacgggaagcagaattatgctttattcaaacaaacctgcttctgcctcattttcctaagctatgagaacaattagagaaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgttacattgatctgtacattattttaagccacatgtttgtaattgtttaaaacaaagtggaaacattacacaatgtccttaataaataggcccatgtaaattttaattacaattaataaatgatcaaaaaatttgcattt

SEQ ID NO: 15159 - DNA, 2137 bp, Homo sapiens
aaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaa

SEQ ID NO: 15160 - DNA, 1555 bp, Homo sapiens
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaatcacaggaccacaccccatttcagggaagcaggaaagtgcaagctcaccagagttcagaaggaggaaaaccagagaattttcaaacaacacaatgtga

SEQ ID NO: 15161 - DNA, 4261 bp, Homo sapiens
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttaccttgtgggaggctacagctggagtatgggggcctacaagtcatctacaatatgctattgtccagagaaaggaacctggacagaactcgaaggagatgtagcagaaccgttggcaggccctgcctgtgtgacagttattctgccctcttgtgtaccatacaacaaataacaccaggaaactctggaatgaacagtatcacattctaggaagcaatggcaggtgacatcactattataataggaacaatgcattctaatggtacaactgccaaaacccacccttggtttctgatgatttataagtaactacaaaagaaagagacctgttcttgaacagatactatgtctataactcagatcgcaccaaacttcctgtggtgacagactcttccatttcagactggttttaacttatcccagctttacaaaaactcttcatgtgaatcttaacttgcaaaaggagaaagataaaatacagaagactggccccagagagacctcagatcagtattgtgcattgtagtctacctgcatgtgatctatgttgacatttcggggatattgtgttcaagaatgattccaaatttgagccaccaaaatacactgcattacagaaattgccacttgattctgtactcttaacctttggctacttcacagactccattggcaacactgttattgaaaatcatgtaagattaaagagaggcattttcgtttctatacaacttcatttcatacaccttctgcccttacagcacctcatgggatcagaaaagagaaagatgttggctcttgtaataaatgctttctaccctataggttctaggctagacagagtcgtcatttctgtgtcctcaattttatctgaaagattaaaacaaaatatattatgtcactattcagttcatggaggtttgtgctttttcatattttgtgatatataagtagtgaacacacatgttatttacttcaaaagacaggattgacaaattcagtcaatactattttagagattctgttagatgatatgtctgacccaaatttaatccataataaaaaaaaatgggagattgttttcaggaattcagggatgaaaagaaagaataatttccattaagtagaattccagttgtctttctgtttctaaaacacagaacttacaagagccacaggagccaattatagcacctgacagaatacttctcctcttcctcaccttcgggtgcctctagacacttgacttacgatcgttattcccccaattcatcatattttgtttgttatcaccagagatgcctgaactcagttaagcgagcaattgctagttgtcttgaggagcatgaggaattcaggagcagaaggtcaggatagcatgagatagtctcaatgtggccaaccaaaaggacaaaactgacaggaatgcacattcgattttcaagccctccagagcttgaacaacaactttaggagtaaataaaagcctaaaatatattttaaccatccagagatggtgttgaatccttcaacaaatgtgtcattcaaaacagtaattagggaaatcccacagatgaaaaatgccttagtgataagctttcatggcagagcacgtcaagataaatgggtatactggaatccgatgccgtttctacagtaaagtgcaatcttcgttgtttttgtatttatttgtatgttcagatccaaaggatccgttgtaaaaatatatatatataaatatatgtatatccagtgcaatcaactgtcatttctttttccttaaaacatatgagtatatagaaagaaaagttacagtactctgtgggaaaatctcagctgacatcatgaatagaatgaggtctgcttcagaaccttttgttgtcaactgtcactgtttcttccaaaagtcacaatttgtacaagaacctttgctttccttagacttgttctgcattttattttttatttctcaccaaaataaaagcatttatgagaattataagtaaagctttctgtatttcagagagacataagttactagaaagtgaaaagtgaataaataagtcacagagaatgtaaattttgtacagtattagaatgtgtaaatgaagcttgcttggaaggggaaaactttaaataaaaactttatgtactaatt

SEQ ID NO: 15162 - DNA, 2442 bp, Homo sapiens
tttttttccttgccaccccttggcctgtttgcctccactcccattaacatccctccaccatggatcccgtgtgccggatttgagacttgcaggcagtgtctttaggaaggaactttaccgggcctcactgccagagctgggctagaacagaggccagtggaaactattaggaagactcagcttttcatgaagttagatttttagcctgagctttaagtcaaagaaagatgacctggacttaaagtgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtatacca

SEQ ID NO: 15163 - DNA, 3134 bp, Homo sapiens
gcgcccgccggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtt

SEQ ID NO: 15164 - DNA, 2907 bp, Homo sapiens
actgccagagctgggctagaacagaggccagtggaaactattaggaagactcagcttttcatgaagttagatttttagcctgagctttaagtcaaagaaagatgacctggacttaaagtgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttca

SEQ ID NO: 15165 - DNA, 6806 bp, Homo sapiens
gattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 15166 - DNA, 1665 bp, Homo sapiens
attctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaagtagagacggggttttaccgtgttagccaggatggtctcaatctcctgacctcgtgatccgcctgcctcagcctcccaaagtgctgggattacagacgtgagccaccgcgcccggccactaattaattttttaattgacaaaagttatatgcatttatcatgtacaacatgaggttttgaaatatagatacattgtggaatggctaaatttagctaattaacatatgtattacatcatatacttatttttttgtggtaagaacacttaaaatccattctcttaactattttcaagaatataatacattgttattaactat

SEQ ID NO: 15167 - DNA, 6566 bp, Homo sapiens
agatttatatatttttaaggcccattggctttgcctaaaccttggtaaacagatactaaaaatctccagtaacattgcaaaattttgttctaattatcaggttcagcttcaaaacgtgtaaaatgcattgtgtactgagagtaagaggctgactctcgttagatccatttctatcagtgtgtttaaagccaaaaggaaagtaaaatacacatggctttcttctgacttgagttgtgtgattatggtcttttactcaagcttaaatgtttttatttttttgtcttccgagttcatgttgcccaaatgtcctgaggtggttccaaataccaatcccacacttcttgaccattgtcctgtggacaataacttggaataaatgtgaaactgaagtctgagtgcccatcagagagtgtcccaatccaaccagtctataagaagatctggggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 15168 - DNA, 1559 bp, Homo sapiens
aaggcccattggctttgcctaaaccttggtaaacagatactaaaaatctccagtaacattgcaaaattttgttctaattatcaggttcagcttcaaaacgtgtaaaatgcattgtgtactgagagtaagaggctgactctcgttagatccatttctatcagtgtgtttaaagccaaaaggaaagtaaaatacacatggctttcttctgacttgagttgtgtgattatggtcttttactcaagcttaaatgtttttatttttttgtcttccgagttcatgttgcccaaatgtcctgaggtggttccaaataccaatcccacacttcttgaccattgtcctgtggacaataacttggaataaatgtgaaactgaagtctgagtgcccatcagagagtgtcccaatccaaccagtctataagaagatctggggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcag

SEQ ID NO: 15169 - DNA, 6981 bp, Homo sapiens
ctcttgtgctctcctctagttttactgaactgccagtactttgaacacactttgtgctttttctcctccaggtctttgtgcatactgtttcctctgcctggaatactcttctttctctttacctgactcgtttctgctcttacttcaagtctcagattctaggaagctttccatcaacctgctatcactgggacgagttggccatcccctgtgcttctgtagctcctatgaaatcataatagttgaaatgtgatgtttaaatgtttacttggcattctcctctactgaactctaagctttgtgagggtagtgatggtggctttgcctattgttttgtttcccttaaatctaaacgcagtgcctggcacatagtagcctccagtaaatgcttgtttaatgaacaaacaaacctgtgaagtgagtgatagagtgcttagtccccttcagttttcaggatggagagatggagaataaggacctcacacaaaatcacacagtacttggtggaagaagctgagctatgacctgccttccttcagaggaatgcactttgctttggaagatatgaagaaattcccagtacattgtctttcctattgggtctgtgtgagaacaggctgatagatgcctctgtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 15170 - DNA, 5743 bp, Homo sapiens
accggattttccttctccctctctctatctccacagatcccttcccaagaggagtctcctgctaaaacttcatcatctcaagttgacctgccacttcacccaaggaggcaagctcttgcctgtaacagtgtatttgccaacatggcacccaaaaagaagattgtcaaaaagaacaaaggagatatcaatgagatgactataatcgtagaagatagccccctaaacaaactgaatgctttgaatgggctcctagagggaggcaatggccttagctgcatttcttctgaactaacagatgcttcttatggccccaacctcttggaaggtttaagtaaaatgcggcaggagaacttcctatgtgacttagtcattggtaccaaaaccaaatcctttgatgttcataagtcagtcatggcttcatgcagtgagtatttttacaacatcctaaaaaaagacccgtcaattcagagggtggatctcaatgatatctcaccactaggcctggccactgtcattgcatatgcctacactggaaagctcactctctccttgtatacaataggaagcattatttctgctgctgtttatcttcagatccatactcttgtaaagatgtgcagtgattttctgatacgggagatgagtgttgagaattgcatgtatgttgttaatattgctgaaacatactccctaaaaaatgcaaaagcagcagcccagaaatttattcgggataacttccttgaatttgcagaatcggatcagtttatgaaacttacatttgaacaaattaatgaacttcttatagatgatgacttacagttgccttctgagatagtagcattccagattgcaatgaaatggttagaatttgaccaaaagagagtaaaatacgctgcagatcttttgagcaatattcgctttggtaccatctctgcacaagacctggtcaattatgttcaatccgtaccaagaatgatgcaagatgctgattgtcacagacttctcgtagatgctatgaactaccacttgcttccatatcatcaaaacacattgcaatctaggcgaacaagaatccgaggtggctgccgagtcctcgtcactgttgggggacgcccaggccttactgagaagtcccttagcagagacatcttgtatagagaccctgaaaatggatggagcaagcttacggaaatgccagccaaaagttttaatcagtgtgtggctgtgatggatggatttctttatgtagccggtggtgaagaccagaatgatgcaagaaatcaagccaagcatgcagtcagcaatttctgcagatacgatccccgcttcaacacctggatacacctggccagcatgaaccagaagcgcacgcacttcagcctgagcgtgttcaacgggctcgtgtacgccgcgggcggccgcaacgcagaaggaagcctggcctcgctggagtgctacgtgccctccaccaatcagtggcagccgaagacgcccctggaggtggcgcgctgctgccacgctagcgcggtcgccgacggccgcgtgctggtgaccggaggctacatagccaacgcctactcgcgctctgtgtgcgcctacgacccggccagcgactcgtggcaggagctgccgaacctcagcacaccccggggctggcactgcgcggtcacgctgagcgacagagtgtacgtgatgggcggcagccagctggggccgcgcggggagcgcgtggacgtgctcaccgtggagtgctacagccccgcgaccggccagtggagctacgcggcgccgctgcaggtgggagtgagcactgcgggcgtctcggcgctgcatggccgcgcctacctggtggggggctggaacgagggcgagaagaagtacaagaagtgcatccagtgcttcagccccgagctcaacgagtggacggaggacgacgagctacccgaggccactgtcggcgtgtcctgctgcaccctctcgatgcccaacaacgtgactcgggaatcccgggccagttcggtatcttctgtgccagtcagtatctgagcccaggtagatgcagggacgcaggaagaacacgttatttattcgtagagccacgtggttaacctctgagttcgcgaaaaggaaaatatttaacatttactacactgattgtattgtaaaatatgtcgaggcacatgtcctgatggctttaaattcctggtatggcataatctacctcttttttttttttttttttttagcaaaatacagggcaatggccaacaaaagaaacaatttatttcagcggccactgggtggcagacggaattcgttataggcactctcccaaggcggcatgtttcctaaatgtatagcggttacacccacatttgagattttttcctctacacgttagtacacttgaggtttatgtaagtgatttcatgttcaaaagtttattttcctctctctcttttttctttaggaagttgaagatattcatatagattttatttatttaaaaatggaaattgtcgatctccataaagacttaagatttaattctgtatttcaacgcaattttccccccatatgtgattgagtaaaggattttgaaagatatcccatgacaacgtaataaagcttaaaacaagatctgaccgaaaaggaatagggattccacccagggaccctaaatttgataacctttgtgttagcggacattcctcttcctccatgcctcaggccccagtttattttctaccataaaatcatgctctcaatgaagtaattgatatgaatcatttaatttatagcataaatttaagtcatttggttgtttcaactagaaggatttgcattttatcccttgtcctctattaaagaagaatttcacataccctgggagccttaccctcaccctaaaaactacaccaacctggttaaaggcaaccttggccctaatgtacaccccgcgaagatcaccaaataaaactatgtccctaaggaccattagccttaagcttagagagcttgaagtttacacaaccaataacaataattttatttgccccaatcttttatatgataagaatgatagaaacatttggaatttgtagatttggtagtaactggatgaatgggttctcctgttgataaatgccattgtttcccatttaatatggatcctcctgatttcttaagtaaaaatcaagcactcatctcacgtatataaaaatatatactcattctgtcctatttttattaatctcatctgctccaaatgagctttggatttataatcaaagtgtacccacttgatagcacttttcctatatgtttgccaagttttggggaaagggaatgactgtagtaaatgatacatattttccttttttataatttatcactttattctttgacagtttatttgttttggagaggaagtggcctatcaattatgggttatgtgcaattggattttgaaaaataaaacaagctatttaggaattgaacatgagatatatggaaatataatttggtttttgttaatctcatcctctccaccttgtgtagataggttattgctagttatgatatttatttctaaaatatgttatttgaactgtgaaaagtggttcatatagtacactttgtggaacaattttatatcattaccccgatgaaaagttcaatctctggatatttaatgataacactcaggtaagggctacaaacgctgtaaattaagaacaagatattattaatgtaaaagcgctgggctgtttccttatcccacacaaagaatcttttaccttggtatatgtggatatggtatattaccttggtgtatgtatatgtgtgtatacgcacacactcatacaactgagaagcctatagtatatggttaatttttggagaaaagggtgttttattgtgggttacagatcataagtgagtgaatagatgtaattccttgatgcacaccaatagatgtgttcccattgacatcttagaagtattgtatgaagaggaggacctagggcttgaaatgaaatgagaatcaatcaattgcaacattacatgatggaataatgagaagagatactgaaactagaggatttttcatctatcaaagcttgataaattaggttgtgcaaaaacttggcagtggctttctagagatgaaactggagacatgttagtgctggataaatcatttaaaattaccatttaatttattttctacattgtttatctgaagactcagaaaatccacatatttgagcttaccagactcttgggtgcattgctgttctatcttctgcttcaacagttaggaaaataaagaccaatatgaatttggaatgtcagaatttctgacataacacattggcgaggagtatggaatgtaagggtcggtgaaagtttcatatcctggaacatcttgcattgccaattgaaagacataaaagtatgcagaatcaaaataatatgtgtccactttcatgtgtaagtgaaacatattctttacaccaactattgaagcagttgctcctagaaacctagtttctccagatttcccaagtggaaaatatttagtatgttttaagcttacattcaattactccagagtcttaggacccaaccatatacttccttttattttttattaaagaaaatgacttgttatttttgtaacggctgagtcctgtgatcaaataaaagcatcagttcaatatatcagggaaattgcatgttacccagcaactgaaataataaaattcaagctctctttttctaaatgggccagagacctgatgagaaagtctccaggaagccaaactttaacatactttgtccatttttagttaggttcttggtgccaagttgtcatccctgatgcattagttgctttcagtgcattgaatgaattttatttttacttcctatgttgtaagaatggttttgaatagaaggtcagtgatggtacagattcgtataattttaaaacatgattagatggtagtgaagtgttatgagtgaggaggtataattgatgtcatgaggaagtgagtactgaatggttctatgatttaaggtaaagcagcagttgtagtaagtgtattttacaaatacacatgtaaatagaggtttacctggaaatatgtacgttctaaaaggtcaattttttaattttatttttttgctggttatcctggccaagtgtcttcagaactcatccaagttacgagacgaaataaactaaaatcacctcattaatttttttcccttagttacaaccaaatgaatttatgtaatctctgaatgaactacatccctattccagccgctgatgaatatgttctccagcacaaggcagcattaaaaggaaatacttttcagtatttcttttcatgccaaaaaacctacagaataattttccaaacagtcctttattcgtaattataagaattaaacaatctaaaatattaaagatttaccctccagcacattcactgggtaaagaccatttaatttgccctctcagggaatttgaaataaattatttgtcctggatattctttaaaaactttttatttattcagcaaattttggcaaaaaaatttctttctttgcttaaaacattctggtactatataaggaacaacaaactaaaatgtatgtagtgttattttgtaatctcatcactatcaataaagctgcattcaataagaccttagtcaatgactaaata

SEQ ID NO: 15171 - DNA, 1905 bp, Homo sapiens
atggcacccaaaaagaagattgtcaaaaagaacaaaggagatatcaatgagatgactataatcgtagaagatagccccctaaacaaactgaatgctttgaatgggctcctagagggaggcaatggccttagctgcatttcttctgaactaacagatgcttcttatggccccaacctcttggaaggtttaagtaaaatgcggcaggagaacttcctatgtgacttagtcattggtaccaaaaccaaatcctttgatgttcataagtcagtcatggcttcatgcagtgagtatttttacaacatcctaaaaaaagacccgtcaattcagagggtggatctcaatgatatctcaccactaggcctggccactgtcattgcatatgcctacactggaaagctcactctctccttgtatacaataggaagcattatttctgctgctgtttatcttcagatccatactcttgtaaagatgtgcagtgattttctgatacgggagatgagtgttgagaattgcatgtatgttgttaatattgctgaaacatactccctaaaaaatgcaaaagcagcagcccagaaatttattcgggataacttccttgaatttgcagaatcggatcagtttatgaaacttacatttgaacaaattaatgaacttcttatagatgatgacttacagttgccttctgagatagtagcattccagattgcaatgaaatggttagaatttgaccaaaagagagtaaaatacgctgcagatcttttgagcaatattcgctttggtaccatctctgcacaagacctggtcaattatgttcaatccgtaccaagaatgatgcaagatgctgattgtcacagacttctcgtagatgctatgaactaccacttgcttccatatcatcaaaacacattgcaatctaggcgaacaagaatccgaggtggctgccgagtcctcgtcactgttgggggacgcccaggccttactgagaagtcccttagcagagacatcttgtatagagaccctgaaaatggatggagcaagcttacggaaatgccagccaaaagttttaatcagtgtgtggctgtgatggatggatttctttatgtagccggtggtgaagaccagaatgatgcaagaaatcaagccaagcatgcagtcagcaatttctgcagatacgatccccgcttcaacacctggatacacctggccagcatgaaccagaagcgcacgcacttcagcctgagcgtgttcaacgggctcgtgtacgccgcgggcggccgcaacgcagaaggaagcctggcctcgctggagtgctacgtgccctccaccaatcagtggcagccgaagacgcccctggaggtggcgcgctgctgccacgctagcgcggtcgccgacggccgcgtgctggtgaccggaggctacatagccaacgcctactcgcgctctgtgtgcgcctacgacccggccagcgactcgtggcaggagctgccgaacctcagcacaccccggggctggcactgcgcggtcacgctgagcgacagagtgtacgtgatgggcggcagccagctggggccgcgcggggagcgcgtggacgtgctcaccgtggagtgctacagccccgcgaccggccagtggagctacgcggcgccgctgcaggtgggagtgagcactgcgggcgtctcggcgctgcatggccgcgcctacctggtggggggctggaacgagggcgagaagaagtacaagaagtgcatccagtgcttcagccccgagctcaacgagtggacggaggacgacgagctacccgaggccactgtcggcgtgtcctgctgcaccctctcgatgcccaacaacgtgactcgggaatcccgggccagttcggtatcttctgtgccagtcagtatctga

SEQ ID NO: 15172 - DNA, 2596 bp, Homo sapiens
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattag

SEQ ID NO: 15173 - DNA, 3288 bp, Homo sapiens
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtatggcattcatgtttcattattacactgactctctttttattaaaacaattcttatggtaaaacagatcccctcaatcttgtccaatactgaaatatatggcataaatatgacaatcacgttttgattagcgatgagaaaaagaggcaatgtttaattttataacataattaaaatccagaattacctttgagatgtaagttaatactcagagaaattattaattatctgctaccacttgcatgatgaagtgttctagcctgattaaagctgataggactactggagggctgcaacaatgggaggggagactggaaaataaaaacaaggatagtagtcagaaaactttgaacaacttgcccatgtgtgagcagtcggatttttaaatactcaacccattgatatctgggagcagattaaagtcctgataacctaatgaagatggcaaccctaaattacactgagtaagaaacctgatctggcagtcttactaacagaaagaatttcacccttgtgtatttctgggagggtctagcacttctaaaaatgatcttttgagatctttgcttccatcatcaccaagaacagaatcaggaatttgtgcttgtgtcacccagttcagtacttggtacataaaagacaataaatgtttaactgagccaagattttcttgtatacaaggagccatgataagtatggtcaagaaaacaaagcttctaggccaggcatggtggcttatgcctataatcccagcactttgggaggctgaggcgggcagatcacgaggtcaggagttcaagaccagcctgaccaatatggtgagaccccatctctactaaaaatacaaaaaaattagccgggcatggtggcacgtgcctgtaatcccagctactcggggggctgaggcaggagaatcgcttgaacccaggaggcagaggttgcagtgagcagagatcatgccactgcacttcagcctgggtgacagagtgagactccatctt

SEQ ID NO: 15174 - DNA, 2690 bp, Homo sapiens
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagata

SEQ ID NO: 15175 - DNA, 909 bp, Homo sapiens
ccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaatgtatttaat

SEQ ID NO: 15176 - DNA, 7656 bp, Homo sapiens
ggtcccctacccccacctactcgcccgccccctccggggccacccggggactctgaccccccggcctggcgccgcctgacggagcgggagtggctcgctccgggccggccggcgccggggatgaggctgcccggacagggtctaggggcgcgcgaggggccgagcatcccactcagctcgccggccccggcccccgcctcccccgctcctcccgcctggccgccccggcccgccgtgacccacggccgcctccggagcccgacgcgcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaaaaaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaatgaataatagagaaaataaatgttagagaggatgtggagaaattgaaaaccttcattcgttgttggtgggaatgttaaatggtgtagccactgtggaaaacagtttggcagttcctcaataagttaaaaaaaagaattaccatatgacccagcaagtccactcctgggcatatactgaaaagaactgaaaacaggtgttcaagcaaaaactttcacgcaaatattcattgcagcactagtcacagtagccaaaaaagaggaaacaacccaaatggccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtg

SEQ ID NO: 15177 - DNA, 6216 bp, Homo sapiens
aagaagcatccatcaactgtaatggttccacaattcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaaaaaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaatgaataatagagaaaataaatgttagagaggatgtggagaaattgaaaaccttcattcgttgttggtgggaatgttaaatggtgtagccactgtggaaaacagtttggcagttcctcaataagttaaaaaaaagaattaccatatgacccagcaagtccactcctgggcatatactgaaaagaactgaaaacaggtgttcaagcaaaaactttcacgcaaatattcattgcagcactagtcacagtagccaaaaaagaggaaacaacccaaatggccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtg

SEQ ID NO: 15178 - DNA, 3425 bp, Homo sapiens
ctcccgcctggccgccccggcccgccgtgacccacggccgcctccggagcccgacgcgcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtca

SEQ ID NO: 15179 - DNA, 3300 bp, Homo sapiens
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataag

SEQ ID NO: 15180 - DNA, 2926 bp, Homo sapiens
ccgccgtgacccacggccgcctccggagcccgacgcggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtc

SEQ ID NO: 15181 - DNA, 6298 bp, Homo sapiens
gggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctttctggcaatgagatcatttcggaacgcaccaagcccaggatgcatgagttccagtctgaggtgttcatgatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcgatcaacaagtggattcagattgagtatttaaacataggccgctggaggcataagatggtggtgttgggtggcaaggtctatgtgatcggaggctttgacggcttacagagaatcaacaatgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccgggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcttgctgggcgtggcggctcacgcctgtaatcccagccctatgggaggctgaggcgggcggatgacctgaggtcaggagttcaagaccagcctggccaacatggtgagaccgccccgtctctactaaaaatacaaaaattagccgcgtgcagtggcaggcgcctgtaattccagctactcaggaggctgaggcaggaggatcacttgaacttgggaggtggaggttgcagtgagccgagatcgccacactgcactgcagcccgggaaacaaaagtgaagctctgtcttcaaaacaaaaacaaaaacaaaaacaaaaacaaagaaacctggctcatttcttgtttcggcaagtctgctaaaagattcactcagcacagcagggaaataaaggtgtttcctgctttctttccttttctttcttattctgcatcctccctcgtccccgccctttaccaatatttaaaccaaggagtcatttgggctccttgccaagaacatctcataggttcttccacttgaaaggtctgggggatgggcttgggaaggcctgtttgctttgaaagagatgaaatacttgtgttctgtcctcctcccattgaaaccctcttttttttttttttgagatgaagtcgcccaggctggagtgcagtggcatgatctcggctcactgcaacctctgtcaccctggttcaagtgattttcctgcctcagcctcctgagtagctgggattacaggcacctgccaccgcgcctggctaatttttgtagttttagtagagacggggtttcaccatcttggccaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagcgtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaa

SEQ ID NO: 15182 - DNA, 3304 bp, Homo sapiens
atagtgcccccgcctccttgcgcgaagtgcgcaggctcctgggcagggctcgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaactt

SEQ ID NO: 15183 - DNA, 3127 bp, Homo sapiens
cgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaa

SEQ ID NO: 15184 - DNA, 3231 bp, Homo sapiens
cgcagttggtagaggggcgcgtaaaacaattctcgagcaaaagtgcttctcgtctgccgaggatgtagctcccaagtcagactcctgggggactcctcaggctggctttcgccgtcgggtatcggttgtgtaacagctctgccctagttatctctttgtggggcgaggatccttccattggcgagccgttttaaggtgccgtgagatcttgtgtgaagaaacccgttggcatagcccaaaccgaagcccccaaagggaggagagttgctggcctgacatcagctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgttttt

SEQ ID NO: 15185 - DNA, 2932 bp, Homo sapiens
atagtgcccccgcctccttgcgcgaagtgcgcaggctcctgggcagggctcgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactgttgcactacaaattcttcaaaatgaaaaaccgcaaggatggaagagtttcagtatcctatgccatactaattcaaggactgaaaatttatgaaatttactcaactaattttcctgaacactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttattttgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaactt

SEQ ID NO: 15186 - DNA, 2696 bp, Homo sapiens
atagtgcccccgcctccttgcgcgaagtgcgcaggctcctgggcagggctcgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaactt

SEQ ID NO: 15187 - DNA, 1970 bp, Homo sapiens
ctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagctaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgac

SEQ ID NO: 15188 - DNA, 2032 bp, Homo sapiens
agttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacaggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatac

SEQ ID NO: 15189 - DNA, 2814 bp, Homo sapiens
atgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaactt

SEQ ID NO: 15190 - DNA, 1053 bp, Homo sapiens
ttagagcagaagcagccatcgataaataccatgccatcttctaagggcactgtgcgcctctgttattaagaggagctctttgttctgtccttggtgtgtggtgcattcgtgaaattctgcagcacatcggcgaaagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtaagaaatatcagattcctgttgtgtgtttattttgttttatcctttatttctaatttaattttttaaaaaggctgattttaagtatccgcatttaaccttaaagacattgtccactagaacgttttctagtaataaaatttaagaggggcttagagagatgcatattaacctgggcagcagcaagcttattaaatattatatcaacattttctaaaacacaaaatggcatttttaatggtttttcacggatctaggacaatgaataaggattgcatgtggtgatagtaacatgattatgaatgtttccttttatttaagcacttatgatatgctaaggtctatcacagatgaggcaacttatagttaggtaacttgccagaggtcacatagctagtgtatgaacgagctgggattggaactcaagtaatctaattcttagctactacaccttgctgcctccc

SEQ ID NO: 15191 - DNA, 969 bp, Homo sapiens
gggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaa

SEQ ID NO: 15192 - DNA, 5621 bp, Homo sapiens
gctcgcgggggctgaggcgagaggacgccaagcgcccgccggggctccgcggggccgcgcaggagagcgcgcgtccgccgggtgctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatatacttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaa

SEQ ID NO: 15193 - DNA, 3245 bp, Homo sapiens
aaattcgagccctcgtgcaccaaccgaaactccacagctgagagggcttggggcccggacagcaggagatccagcccctgagcaaccttccacggcttttgtcgcccccattggcgggaggagcagggttatgctcccggctcccgtaggggagctccagcctctggctctgtcagcctccccggcagctccttgactccttcctcccagtctttcgaagaggggcccaggcagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttac

SEQ ID NO: 15194 - DNA, 2394 bp, Homo sapiens
ggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggt

SEQ ID NO: 15195 - DNA, 2592 bp, Homo sapiens
ctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctg

SEQ ID NO: 15196 - DNA, 2563 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctg

SEQ ID NO: 15197 - DNA, 2812 bp, Homo sapiens
attttgtcatcgcaacactaaacctttgtcggtctggtgctccccaattcatgaattgcttcttacttaaataaactctttaaaattttactgtgcctcatattttttttaatacagaagaaatgagagaaggaagaatattttagaaataaaggaacttcatgggcagagtcacagtgcaagacaaaaggagcagaccaagggcaagattgcttggggagtgaagactccctccctcttctcccctgagaagctgagataaagggggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaa

SEQ ID NO: 15198 - DNA, 2451 bp, Homo sapiens
agaggagtgtttagctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgaggatgaaatcaacaagcggacaaatgcagagaatgaatttgtgaccatcaagaaggatgtggatggtgcttatatgaccaaggtggaccttcaggccaaacttgacaacttgcagcaggaaattgatttccttacagcactctaccaagcagagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaagtatgaagagctgcagatcactgctggcagacatggggatagtgtgagaaattcaaagatagaaatttctgagctgaatcgtgtgatccagagacttagatctgaaatcgacaatgtcaagaagcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgcgactaccaggagctgatgaacacaaagctggccctggatctggagattgccacctacaggaccctcctggagggagaagaaagcaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtagcagctacggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattc

SEQ ID NO: 15199 - DNA, 2124 bp, Homo sapiens
cagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcatctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggccacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaacta

SEQ ID NO: 15200 - DNA, 2227 bp, Homo sapiens
agttgtggccaccttccccaggccatggatctctccaacaacaccatgtcactctcagtgcgcacccccggactgtcccggcggctctcctcgcagagtgtgataggcagacccaggggcatgtctgcttccagtgttggaagtggttatgggggaagtgcctttggctttggagccagctgtgggggaggcttttctgctgcttccatgtttggttctagttccggctttgggggtggctccggaagttccatggcaggaggactgggtgctggttatgggagagccctgggtggaggtagctttggagggctggggatgggatttgggggcagcccaggaggtggctctctaggtattctctcgggcaatgatggaggccttctttctggatcagaaaaagaaactatgcaaaatcttaatgatagattagcttcctacctggataaggtgcgagctctagaagaggctaatactgagctagaaaataaaattcgagaatggtatgaaacacgaggaactgggactgcagatgcttcacagagcgattacagcaaatattatccactgattgaagacctcaggaataagatcatttcagccagcattggaaatgcccagctcctcttgcagattgacaatgcgagactagctgctgaggacttcaggatgaagtatgagaatgaactggccctgcgccagggcgtagaggccgacatcaatggcctgcgccgggtgctggacgagctgaccctgaccaggaccgacctggagatgcagatcgagagcctgaacgaggagctggcctacatgaagaagaaccacgaggatgagctccaaagcttccgggtgggcggcccaggcgaggtcagcgtagaaatggacgctgcccccggagtggacctcaccaggctcctcaatgatatgcgggcgcagtatgaaaccatcgctgagcagaatcggaaggacgctgaagcctggttcattgaaaagagcggggagctccgtaaggagattagcaccaacaccgagcagcttcagtccagcaagagcgaggtcaccgacctgcgtcgcgcctttcagaacctggagatcgagctacagtcccagctcgccatgaagaaatccctggaggactccttggccgaagccgagggcgattactgcgcgcagctgtcccaggtgcagcagctcatcagcaacctggaggcacagctgctccaggtgcgcgcggacgcagagcgccagaacgtggaccaccagcggctgctgaatgtcaaggcccgcctggagctggagattgagacctaccgccgcctgctggacggggaggcccaaggtgatggtttggaggaaagtttatttgtgacagactccaaatcacaagcacagtcaactgattcctctaaagacccaaccaaaacccgaaaaatcaagacagttgtgcaggagatggtgaatggtgaggtggtctcatctcaagttcaggaaattgaagaactaatgtaaaatttcacaagatctgccccatgattggttccttaggaacaagaaatttacaagtagaaattattcctttcagagtaacatgctgtattacttcaatccctatttttgtctgttccattttctttggattccctattcacattgaatcctttttgcccttctgaaacaatattcagtcacaagtcattttggtcatgttggtctttgtaacaaatcaaaattaccttatatccttctggacctggagtagtcttttaacgaactttcttctggtaacccggaatattttttaatcatagagctttaatcaagtagtattgttttaatagagttaattgtaataaaagatgaatggtaataatgtgaaatgtatgccttgattccaacaagaatgtcaagagcatagagagaagtttttgaaatactactaataaaatagaggctgggagtaatgactcacacctataatcccagcactttgggaggctgagaggcaagatgattgcttgaggcccggagttcaagaccagcctggacaacatagagagacccccatctctacacaacattaataatgataataatgataatgtagataaaactgggatgaagatgtcagggtttgaggattaagctaaaagaagattcttttagaagttctggcctttttatgtaagctcatcaaggttgtagcaaaattatattgtctactacagca

SEQ ID NO: 15201 - DNA, 1068 bp, Homo sapiens
atgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacactgcagcagatccagggactcatcagcagcatcgaggcccagctgagcgagctccgcagtga

SEQ ID NO: 15202 - DNA, 1699 bp, Homo sapiens
ggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcggatctctctcctctctgacctggatacgctttggtttctcaacttctctaccccaaagaaaagattattcaataaagtttcctgcctttctgcaaacata

SEQ ID NO: 15203 - DNA, 1673 bp, Homo sapiens
ggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcggatctctctcctctctgacctggatacgctttggtttctcaacttctctaccccaaagaaaagattattcaataaagtttcctgcctttctgcaaacata

SEQ ID NO: 15204 - DNA, 5237 bp, Homo sapiens
aaatgtactcagcaccctgctaaggaggctggagaccccatcacggccatggcaatcccgaaggaggagctgtttcaaggttggttatgaacatgtaaccccagagccccgctgctgtagcctggactgggacccccttctgccccctccctagctgtcctgttctggcctccagcacccacaaaccaccacccccaacttaacttctcaggaagccttggagctggagggagaggcctggctgcacccccagctgggactgcccagaggcgcttgtccctgcccatgaaagcctcccttgtcacagctgaaaccttccctctgcctcaggggcccctggaatgtggctgcggggcggggtctgggcccacacaggtggggcaggtgactgtcaggtctcaggcctgagtgtcaggaatgaagcctgcctttgtgtgtgcacagtgcagggtggggctggactggggacacttttctgtctcagcctggagacctgggataggagggagaggggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtaagtctctgggctccaggacacaccccctctccctggcatttccctggggaacaggagaggtgtgggagggttctaaggttgttggagacttcattctccttgtgccctcaaatgctcactatggccctgaggggagtctgtgttaatggcctaagtttaaatcaggaaccaggctcagagaggctgagtctctttccactgggctgcactgcctcattctaaggagaaaaggccagctccacagatggccccatctggctgcagtgggcaaaggtcagaaactggcacagcatcctgggcaggctgcctggggcagggcccggggctacagcctgggctggggccagacagagctttatcttcgcaaggccatcccacctggtgctaatgaggaggctccgggccccacccagatctggagctcacagtagcggtttggactgaaaccagggatttgtgcgtggggcagtgaggggggcagctgccgcccctggcctgggcctgagagtatagagaaagccacctcgaggggctgctggaggagagtcaggtgcagaaggggatctggctggggtccagcccttcctcaccctggggtgaaaggcgagtaattgttcttgagttaattgctggggccacaatgtctgcagaggcttttaatgagctctggatgatctgagtttgattatttttctttcggaggaaaagacaataccctcccacccatgagacaataccacactgtctgtgcccagcattggaggccaggctcactgcgaagatggatgagaaggaacccacccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggttttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaatatc

SEQ ID NO: 15205 - DNA, 3758 bp, Homo sapiens
agctctggatgatctgagtttgattatttttctttcggaggaaaagacaataccctcccacccatgagacaataccacactgtctgtgcccagcattggaggccaggctcactgcgaagatggatgagaaggaacccacccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggttttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaata

SEQ ID NO: 15206 - DNA, 2393 bp, Homo sapiens
gcacagctggtaaatgggaaaagaggggtttaaagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 15207 - DNA, 2527 bp, Homo sapiens
aaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagtaggcgcctgggcacaggggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagatcgtgccactgcactccagcctgggcgacagagtgagattccgtctcaaaaaacaaaacaaaacaaaacaaaatctgtctacttggggatagcaggcctggatgggctagcaggatgtcccacccctagaggagtcagatgtgtgggtggtggtggtgtagggtctgaagaacactgcatagctatctacatgagcttcccttacggacacttgagcttgtgccctttgcttaaatcagcttccctctttctttcaggatggctggcattgccatcagggaaggtaggaaggctttactcttctggtgtggggtggggaggggagatgttgaagccaccacccccttcggaatagggaggaaggagaaagagcccaaacatcccattaggtgggaacattcccattcattagatgcctcttccccagtgggaacttctgtcagccccaggtgagattgcagctggtgatttattgagaaacttccaggttgagtaggcttcattcagggcatgtctctcccccaggccccatcttcatacacttccgctaagatgcccacaattcatcccccttcatgtgcagcttgaaaaaccctgacattgttgctccctgccgggcatacctgccattgccactgcccatctctgtgatgaggaattcaacaccagatctctggcagctcttgagggattggccagtggccattctcaggggtgctgtctagttttcccagagccccgccaaggtcctggccaccgtggcagagcggggaggttcccccactctaaagcctactccttctctctctagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 15208 - DNA, 903 bp, Homo sapiens
gaagaggccccaaaagaagtcccacttcttcctggtggagaggtgagggctgcaggcccaaccctatgagtgatgggggcaagtgagggacactagttccacgcccgcatgctgccaaatgtactcagcaccctgctaaggaggctggagaccccatcacggccatggcaatcccgaaggaggagctgtttcaaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaa

SEQ ID NO: 15209 - DNA, 1644 bp, Homo sapiens
gccttcctgagcacctttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaa

SEQ ID NO: 15210 - DNA, 1524 bp, Homo sapiens
ctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctatgaaa

SEQ ID NO: 15211 - DNA, 2403 bp, Homo sapiens
ttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcagctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtatgaggatgaaatcaataagcgcacagctgctgagaatgattttgtgacgcttaaaaaggacgtggacaatgcctacatgataaaggtggagttgcagtccaaggtggacctgctgaaccaggaaattgagtttctgaaagttctctatgatgcggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaagtatgaggagctccaggtgactgtcgggagacatggagacagcctgaaagagatcaagatagagatcagcgagctgaaccgcgtgatccagaggctgcagggggagatcgcacatgtgaagaagcagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgcaattca

SEQ ID NO: 15212 - DNA, 3078 bp, Homo sapiens
caaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattttttcctgtttctgaattgtaaaaccccctttgggagtccctggtttcttattgagccaatttctgggttaatcttattgatttttcagcatcagtacaactctacaacctttgagctatatctgctttttcccattgcttccactgccttttaaaactcaacacagctttttgaataatttgagagtcaaattcaatcacaaatgctgagcagaataagagtgaagtacactatacttaaaatggaaatagattaaaaacaacattactgaaacccttctcaaggcaaaatgtgtctccttttgataataagctgcatatactatcaggtcctctctttctttatatggtgaacatatatttttaatgaaatgtctctcatttttttaataacagatttattgagatataattcacacaccatgaaattcacccttacaaaacgtacaattcagtggtcttcagtatgcttacaatgttttgcaaccatcaccactatctagttttagaacacttcatcaccccaaaaggaaatcttgtacctattagtagtcaccgccttttcccttcctcccagcccctaacaaccactaatctacttcctgtctctacggatttgcctactctggacatttcatataaataggttaatacgatgtgtccttttatacacaaatgttcatagcagcattactcataaaagccccaaagcgaaacacctcaagtgtccatcaaccgatgaatggataaacaaaatgtaatatatccacacaatagaatcttattcgtcaataaaaaggaatgaagtactgatacatgctataacagagatgaacttcgaaaacatgctaagtgaaagaagccaaatccaaaaacaataaaaacacatattgtatcctcaccctttttgcattttagtgagcaatcattgcatatgaatgtttatgggaaaaatcaatgtgtgctaaatcattgtattccagtaaatagattggacttaaaacttgatacagaagttgcaaataagtgggattgagtttgattattatatagaaaataattacatgattcatttaagaataataatatccaccatttattgagcacttactatgagcctgtgtgccaaacatttcatgcatttctcatttaattctcacaataatcctgtgaggtagaagctattaggttgaatcatatgaacttgccaatatatgataatttctaagagttgggaatttttgaggatgtgaatggtaccactttgaattcctaagatgtaatataatatctaacacatagcaggcacttgattcattattttaaattgaaagaataaagatttttttaaagcttt

SEQ ID NO: 15213 - DNA, 1881 bp, Homo sapiens
actcttcgtcatcacctctcctattcgcctggacaagctcatgtttgcaggagcaccatgtcttgctcgtctcgcgcctcctcctccagggctggaggcagcagctcagccagggtgtctgctggtggaagcagcttcagcagtggaagcagatgtggtctggggggcagctcggcccagggcttccgaggaggagccagcagctgcagcctgagtggggggtctagcggtgcttttgggggcagctttggagggggctttggtagctgctcagtagggggtggttttgggggagcttcaggctctgggacaggatttggtgggggttctagctttggcggggtctctggatttggcaggggttctggattctgtgggagttctagattcagcagtggtgctactggaggcttctacagctatggtggtggtatgggaggtggtgttggcgatggggggcttttctctggaggggaaaagcaaaccatgcagaacctcaatgaccgcttggccaattacctagacaaggtcagagccctggaggaggctaacactgatctggagaacaaaatcaaggagtggtatgacaaatatgggcctgggtctggagacggtggatcgggaagagattatagcaaatactattcaataattgaagatctcagaaaccagatcattgctgccactgttgaaaatgctgggatcattttgcacattgacaatgccagattggctgctgatgacttcagactgaagtatgagaacgagctgtgtctccggcagagcgtggaggctgacatcaatggcctgcggaaagtcctggatgacctgactatgacccgctctgacctggagatgcagattgagagtttcaccgaggagctagcctacctgaggaagaaccacgaggaggaaatgaagaatatgcaaggaagctctggaggggaggtgaccgtagaaatgaatgctgcgccagggaccgacctgaccaaattactgaatgacatgagggcgcagtacgaggagctggctgagcaaaaccgccgagaggctgaggagcggttcaacaagcagagcgcatcactacaagcacaaatctccactgatgctggggcagccacttctgccaagaatgagataacagaactaaaacgtaccctgcaagccctggaaattgagcttcagtcccaactggccatgaaaagctccctggagggaaccctggctgacacagaagctggctacgtggctcagctgtcagaaattcaaacgcagatcagtgccctggaggaggagatctgccagatctggggtgagactaaatgccagaacgcagagtacaagcaattgctggacatcaagacacgcctggaggtggagatcgagacctaccgccgcctgctcgatggagagggaggtggttctagttttgcagaatttggtggtagaaactcaggatctgtaaacatgggatccagggatctggtatctggtgactcaagatctggaagctgttctggtcaaggacgagattcaagcaagactagagtgactaagactatcgtagaggagttggtggatggcaaggttgtctcgtctcaagtcagcagtatttctgaggtgaaagttaaataaggaacttccagatcaacaaaagtgtctttcaaagaaaaaaaaatcaagaaggacacaagcgaagaaatggcatcaatctaggcatctttctggataatttcaggaaaagcttcagtccagaaatggatgactagccaacttttctgcatcttcttatttcctcattagaatgctcttgaaatagctgaattaacaactttgctttaattgtttctatgcttcaataaatttacttttgcaagttaa

SEQ ID NO: 15214 - DNA, 2312 bp, Homo sapiens
ccctcttcctctgactctcagtgtccctgcttaacttacactcttctcttcgccaagctccttaccatgagcagacaagccagcaagacatctggtggcgggagccagggtttctccggccgctctgctgtggtctccggcagcagcaggatgagctgtgtggcccactctgggggagctggcggaggggcctatggcttccggagcggagcaggtggctttggcagtcgcagcctctacaacctgggcggcaacaagagcatctccatcagcgtggcagctggcggctcccgggctggaggctttgggggagggcggagcagctgtgcctttgcaggtggctatggaggtggctttgggagcggctatggaggtggctttggtggtggctttggtggtggcagaggaatgggaggtggctttggtggagctggtggctttggaggggctggtggctttggaggggctggtggctttggtggtcctggtggctttggtgggtctggtggctttggtgggcctggcagcttgggcagtcctggtggctttggccctgggggctttcctgggggaattcaggaagtgactatcaaccagagtctcctgcagcccctcaatgtggagatcgacccccagattgggcaagtaaaggcccaggagcgggaacagatcaagaccctcaacaacaagtttgcctccttcattgacaaggtgcggttcctggagcaacagaacaaagtcctggagaccaagtggaacctgctccagcagcagggcacaagttccatctcaggcacaaacaaccttgagcctctttttgagaatcacatcaactacctgcggagctacctggacaacatcctcggggagagagggcgcctggactctgagctgaagaacatggaggacctggtggaagacttcaagaagaaatatgaggatgaaatcaataaacgtacagctgctgagaatgaatttgtgactctgaagaaggatgtggacagtgcctatatgaacaaggtggagcttcaggccaaagtggatgccttgatagatgagatcgacttcttaaggaccctctacgacgctgagctatctcagatgcagagccacatcagtgacacatctgtggtgctgtccatggacaataatcgctccctggacctggacagcatcattgctgaagttcgtgcacagtatgaggatatcgctcagagaagcaaggccgaagctgaggccctgtaccagaccaagttgggggagctgcagaccacggctggcaggcatggggatgacctaagaaataccaagagcgagatcatagagctcaacagaatgatccagaggctgcgggcagagatcgagggtgtcaagaagcagaatgccaacctgcagacggccattgccgaggccgagcagcatggagagatggccctcaaggatgccaatgccaagctccaagagctgcaggctgctctacagcaggcgaaggatgacctggcgcggctgctacgtgactaccaggagctgatgaatgtcaagctggccctggacgtggagatcgccacctaccgcaagctgctggagggcgaggagtacagcaggatgtctggagagtgtccgagtgctgtcagcatctccgtggtcagcagcagcacgacttccgcctccgcaggtggctatggaggaggttacggcggaggcatgggcggtggtttaggaggtggcttcagtgcgggcggcggctcaggcagtggctttggccggggaggcggcggtggaatcggcggtggatttggcggcggcagcagcggtttcagcggtggcagcggctttggctccatctctggcgcccgctatggagtcagtggcgggggcttcagctcggccagcaaccggggcggcagcatcaagttctcccagtcctcccagtcctcccagcgctactccagataaagagcacgcatcagcatcgcagccactccagcgcctcccctccgctccccacgcccccatattggcaacacccccagcgccaccccatgctccccaagaacgcggctctgcgctggaaggcttgtggcctcttgctcctccttccagatccccggccaagcccagtcacgagaatttcaggctcttctctccggctccagcctgtgcctgtgattgtccaggtgtggcctaggccgccaccttctgctgccccggagtcccctccctgggtgggatgctcactacagctctgatgtatatagcacacagccccctccgcccctccggtctgtcgccaataaagtgcactgtgtttc

SEQ ID NO: 15215 - DNA, 2319 bp, Homo sapiens
atttcccatccctcttcctctgactctcagtgtccctgcttaacttacactcttctcttcgccaagctccttaccatgagcagacaagccagcaagacatctggtggcgggagccagggtttctccggccgctctgctgtggtctccggcagcagcaggatgagctgtgtggcccactctgggggagctggcggaggggcctatggcttccggagcggagcaggtggctttggcagtcgcagcctctacaacctgggcggcaacaagagcatctccatcagcgtggcagctggcggctcccgggctggaggctttgggggagggcggagcagctgtgcctttgcaggtggctatggaggtggctttgggagcggctatggaggtggctttggtggtggctttggtggtggcagaggaatgggaggtggctttggtggagctggtggctttggaggggctggtggctttggaggggctggtggctttggtggtcctggtggctttggtgggtctggtggctttggtgggcctggcagcttgggcagtcctggtggctttggccctgggggctttcctgggggaattcaggaagtgactatcaaccagagtctcctgcagcccctcaatgtggagatcgacccccagattgggcaagtaaaggcccaggagcgggaacagatcaagaccctcaacaacaagtttgcctccttcattgacaaggtgcggttcctggagcaacagaacaaagtcctggagaccaagtggaacctgctccagcagcagggcacaagttccatctcaggcacaaacaaccttgagcctctttttgagaatcacatcaactacctgcggagctacctggacaacatcctcggggagagagggcgcctggactctgagctgaagaacatggaggacctggtggaagacttcaagaagaaatatgaggatgaaatcaataaacgtacagctgctgagaatgaatttgtgactctgaagaaggatgtggacagtgcctatatgaacaaggtggagcttcaggccaaagtggatgccttgatagatgagatcgacttcttaaggaccctctacgacgctgagctatctcagatgcagagccacatcagtgacacatctgtggtgctgtccatggacaataatcgctccctggacctggacagcatcattgctgaagttcgtgcacagtatgaggatatcgctcagagaagcaaggccgaagctgaggccctgtaccagaccaagttgggggagctgcagaccacggctggcaggcatggggatgacctaagaaataccaagagcgagatcatagagctcaacagaatgatccagaggctgcgggcagagatcgagggtgtcaagaagcagaatgccaacctgcagacggccattgccgaggccgagcagcatggagagatggccctcaaggatgccaatgccaagctccaagagctgcaggctgctctacagcaggcgaaggatgacctggcgcggctgctacgtgactaccaggagctgatgaatgtcaagctggccctggacgtggagatcgccacctaccgcaagctgctggagggcgaggagtacaggatgtctggagagtgtccgagtgctgtcagcatctccgtggtcagcagcagcacgacttccgcctccgcaggtggctatggaggaggttacggcggaggcatgggcggtggtttaggaggtggcttcagtgcgggcggcggctcaggcagtggctttggccggggaggcggcggtggaatcggcggtggatttggcggcggcagcagcggtttcagcggtggcagcggctttggctccatctctggcgcccgctatggagtcagtggcgggggcttcagctcggccagcaaccggggcggcagcatcaagttctcccagtcctcccagtcctcccagcgctactccagataaagagcacgcatcagcatcgcagccactccagcgcctcccctccgctccccacgcccccatattggcaacacccccagcgccaccccatgctccccaagaacgcggctctgcgctggaaggcttgtggcctcttgctcctccttccagatccccggccaagcccagtcacgagaatttcaggctcttctctccggctccagcctgtgcctgtgattgtccaggtgtggcctaggccgccaccttctgctgccccggagtcccctccctgggtgggatgctcactacagctctgatgtatatagcacacagccccctccgcccctccggtctgtcgccaataaagtgcactgtgtttca

SEQ ID NO: 15216 - DNA, 1596 bp, Homo sapiens
gagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaa

SEQ ID NO: 15217 - DNA, 1750 bp, Homo sapiens
ttctatcatgagccccctcactgcaagggcataaaatggcccgggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaagattctgtgtaccaaggcagagaatgccaggatggttgtgaacattgataatgccaaactggctgccgatgacttcagggccaagtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagaacgaggactgcaagctgccctgtaacccatgctccactccttcctgcaccacctgtgtgccctccccatgcgtgccccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaa

SEQ ID NO: 15218 - DNA, 1287 bp, Homo sapiens
gagattttggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaactgcaactggttctgtgagggctccttcaatggcagtgagaaggagaccatgcagttcctgaacgaccgcctggccagctacctggagaaggtgcgtcagctggagcgggacaacgcggagctggagaacctcatccgggagcggtcacagcagcaggagcccttggtgtgtgccagctaccagtcctacttcaagaccattgaggagctccagcagaagatcctgtgcagcaagtctgagaatgccaggcttgtggtgcagatcgacaatgccaagctggcctcagatgacttcaggaccaaatatgagaccgagctgtccctgcggcagctggtggagtcggacatcaatggcctgcgcaggatcctggatgagctgaccctgtgcaggtctgacctggaggcccaggtggagtccctgaaggaggagctgctgtgcctcaagcagaaccatgagcaggaggttaacaccctgcgctgccagcttggagaccgcctcaacgtggaggtggacgctgctcccactgtggacctgaaccaggtcctgaatgagaccaggagtcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacggtcaatgccctggagatcgagctgcaggcccagcacaacctgcgagactctctggaaaacacgctgacagagagcgaggcccgctacagctcccagctgtcccaggtgcagagactgatcaccaacgtggagtcccagctggcggagatccgcagtgacctggagcggcagaaccaggagtatcaggtgctgctggacgtgcgggcgcggctggagtgtgagatcaacacgtaccggagcctgctggagagcgaggactgcaagctcccctccaacccctgcgccacaaccaatgcatgtgacaagtccactgggccctgtatctctaatccctgtggcctacgtgctcggtgtgggccttgcaacacatttgggtactagaggccccacaaccaggaggagaagaaa

SEQ ID NO: 15219 - DNA, 1607 bp, Homo sapiens
ggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaagatcctgtgcagcaagtctgagaatgccaggctggtggtgcagatcgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagaca

SEQ ID NO: 15220 - DNA, 1728 bp, Homo sapiens
aaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggc

SEQ ID NO: 15221 - DNA, 1751 bp, Homo sapiens
aaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataataaatgtttctcattcata

SEQ ID NO: 15222 - DNA, 1778 bp, Homo sapiens
ctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcgggtgacccagatggccatggctattgtctccagggcttgaacttggcctctacccaaacttaacccttgtagcccaatcccctctcttcgcgcagagcccaggcccagggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcacca

SEQ ID NO: 15223 - DNA, 1670 bp, Homo sapiens
ctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcggggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcacc

SEQ ID NO: 15224 - DNA, 1644 bp, Homo sapiens
atggccacccagacctgcacccctaccttctccactgggtctatcaagggcctctgtggcacagcaggcggcatctctcgggtgtcctccatccgttctgtgggctcctgcagggtccccagtctcgccggtgctgcagggtacatctcttctgctaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtgacagcccacttggtccaccagggcagggccctgaccacaggaaggaggacacccctgtggctcctggaggcttaacgaccctgcccttctctagaggggtccccctacgcttagcaggtttttctaccaaaacactccccgtattgtgtttccggacttaactgtgcttttacgccatgcaaaaccaggtttcctggaaatttacccaataaagtgtgttctcctggcatagcaaactcaa

SEQ ID NO: 15225 - DNA, 1707 bp, Homo sapiens
gcagcttgaacttagttctcgctgagtcccggctcagggcccttcccttgggtcggggggttggctgtgcagtcaacaataaggaaaaaggcaagacactgagggcagctgaaagacttttacctttgacgagctggtcacctgctccagggaaggtacattcctctccccacaaccctagaggcacctctctggtccacagtgtccctcctgatgctcaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtgacagcccacttggtccaccagggcagggccctgaccacaggaaggaggacacccctgtggctcctggaggcttaacgaccctgcccttctctagaggggtccccctacgcttagcaggtttttctaccaaaacactccccgtattgtgtttccggacttaactgtgcttttacgccatgcaaaaccaggtttcctggaaatttacccaataaagtgtgttctcctggcatagcaaactcaa

SEQ ID NO: 15226 - DNA, 1475 bp, Homo sapiens
atgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaaactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcaga

SEQ ID NO: 15227 - DNA, 1506 bp, Homo sapiens
atgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgtctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccaaagagagatgcttgttatacctttagaaaatctggcttctaactttctgtatgtataggcctgtccaaaggctatgagataccagggacag

SEQ ID NO: 15228 - DNA, 2576 bp, Homo sapiens
gacttgctccggtttgcagagctaggaggtggcaggctgtgcgctcaaactcaggctgtctaactccacattctgtggggtgagaggatgggtgatggggtgtcttttctggaggagggaggtgctgtgagcctagcgagatggaggtacagtgggtgtgggcctggagcgctgggcccaggcaggggcttctgattaggaagccctggggcaccagttcaggttctcccagagagtagtgtgatgggatccagtaacctgtgccctccagatgacttctgtaggtgtgtttagtgacatgctcaacgggtgcgggaaggatgggcttgtgccaagggccaagcccagagatgtttcagatttttccctttatgcccctgcaaccaagccctgctgctccaggacatataagagacgaaggctgagggctccagcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatggacagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 15229 - DNA, 2023 bp, Homo sapiens
atgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcaaaggtgcctgctttgggggtgctggaggctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatggacagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 15230 - DNA, 2576 bp, Homo sapiens; identical to SEQ ID NO: 15228

SEQ ID NO: 15231 - DNA, 2310 bp, Homo sapiens
agtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatggatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctgtttgcaattgctaaataaagcagatttataatacaata

SEQ ID NO: 15232 - DNA, 2109 bp, Homo sapiens
atggccagcacatccaccaccatcaggagccacagcggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatggatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctgtttgcaattgctaaataaagcagatttataatacaata

SEQ ID NO: 15233 - DNA, 2282 bp, Homo sapiens
cgcctccagcctctcacactctcctaagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtgctgccgccagctctcagtcccacagctctcaggcccctctctggcagcagagccctctcctcaggttgcttgtcctcccctggcctccagtctcccctgccctcccgggtagagctgggatgccctcacttttcttctcatcaatacctgttccactgagctcctgttgcttaccatcaagtcaacagttatcagcactcagacatgcgaatgtcctttttagttcccgtattattacaggtatctgagtctgccataattctgagaagaaaatgacctatatccccataagaactgaaactcagtctaggtccagctgcagatgaggagtcctctctttaattgctaaccatcctgcccattatagctacactcaggagttctcatctgacaagtcagttgtcctgatcttctcttgcagtgtccctgaatggcaagtgatgtaccttctgatgcagtctgcattcctgcactgctttctctgctctctttgccttcttttgttctgttgaataaagcatattgagaatgtgaa

SEQ ID NO: 15234 - DNA, 1723 bp, Homo sapiens
atgctctccatatataagctgctactggagtccgattcctcgtcctgcttctcctccctctcgcctccagcctctcacactctcctaagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtgctgccgccagctctcagtcccacagctctcaggcc

SEQ ID NO: 15235 - DNA, 2289 bp, Homo sapiens
cgcctccagcctccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtcggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggcactcaaggatgctaagaacaagctggaagggctggaggatgccctgcagaaggccaagcaggacctggcccggctgctgaaggagtaccaggagctgatgaatgtcaagctggccctggatgtggagatcgccacctaccgcaagctgctggagggcgaggagtgcaggctgaatggcgaaggcgttggacaagtcaacgtctctgtagtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtctcctcaggttgcctatcctctcctggcctctagtcttccctgctctccgaggtagagctgggtatggatgcttagtgccctcacttctctctgtctatacctgccccatctgagcacccattgctcaccatcagatcaacctttgattttacatcataatgtattcaccaatggagcttcactttgttactaaattattaatttcttgcctccaaaattgttctctctgaggctgagcattataagaaaatgatctctgttccttttcattactgaaaatcgcctggggcttatttcagaacaacttccacttattttccattggcccccaaactccctaagttaaaagtattgtgaacccccgccccgcagtatgcatggaagcacaagtgactagtcgtatgatgtacacagtctttctccctgtgatgatttctctgctctttgctctttgtaatttctaaataaagcaggttttagaataa

SEQ ID NO: 15236 - DNA, 2189 bp, Homo sapiens
atggccagcacatccaccaccatcaggagccacagcagcagccgctctggcttcagcagcatctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtcggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggcactcaaggatgctaagaacaagctggaagggctggaggatgccctgcagaaggccaagcaggacctggcccggctgctgaaggagtaccaggagctgatgaatgtcaagctggccctggatgtggagatcgccacctaccgcaagctgctggagggcgaggagtgcaggctgaatggcgaaggcgttggacaagtcaacgtctctgtagtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtctcctcaggttgcctatcctctcctggcctctagtcttccctgctctccgaggtagagctgggtatggatgcttagtgccctcacttctctctgtctatacctgccccatctgagcacccattgctcaccatcagatcaacctttgattttacatcataatgtattcaccaatggagcttcactttgttactaaattattaatttcttgcctccaaaattgttctctctgaggctgagcattataagaaaatgatctctgttccttttcattactgaaaatcgcctggggcttatttcagaacaacttccacttattttccattggcccccaaactccctaagttaaaagtattgtgaacccccgccccgcagtatgcatggaagcacaagtgactagtcgtatgatgtacacagtctttctccctgtgatgatttctctgctctttgctctttgtaatttctaaataaagcaggtttt

SEQ ID NO: 15237 - DNA, 2265 bp, Homo sapiens
acaaccagcagaaccttttgggattttgccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactgggacctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctca

SEQ ID NO: 15238 - DNA, 2015 bp, Homo sapiens
atttaaggggcgagctgggccgagaacgcagcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 15239 - DNA, 1764 bp, Homo sapiens
atttaaggggcgagctgggccgagaacgcagcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaa

SEQ ID NO: 15240 - DNA, 1679 bp, Homo sapiens
tttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaagaaaacaccagcatttatagcatgagaagctacctctgtctcatgaaaactcactgaggcagaggcagatggtaccattgcttaagccctcttcctgattccatatagaccgggtcctatttcttgtcttggagatccaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgag

SEQ ID NO: 15241 - DNA, 1813 bp, Homo sapiens
acttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 15242 - DNA, 2284 bp, Homo sapiens
tcagcatcttatccccactttctggcctccccaccatgagccgccaattcacctacaagtcgggagctgctgccaaggggggcttcagcggctgctccgctgtgctctcagggggcagctcatcctcctaccgagcagggggcaaagggctcagtggaggcttcagcagtcggagcctttacagcctggggggtgcccggagcatctctttcaatgtggccagtggcagtgggtgggcaggaggctatggatttggccggggccgggccagtggctttgctggcagcatgtttggcagtgtggccttggggtccgtgtgtccgtcgttgtgcccgcccgggggtatccatcaggtcaccatcaacaagagcctcctggcacccctgaacgtggagctggaccctgaaatccagaaagtgcgtgcccaggagcgggagcagatcaaggtgctgaacaacaagttcgcctccttcattgacaaggtgcggttcctggagcagcagaaccaggtgctggagaccaagtgggagctgctacagcagctggacctgaacaactgcaagaataacctggagcccatccttgagggctacatcagcaacctgcggaagcagctggagacgctgtctggggacagggtgaggctggactcggagctgaggagcgtgcgcgaagtggtggaggactacaagaagaggtatgaagaagaaataaacaagcgcacaactgctgagaatgaatttgtggtgcttaagaaggacgtggacgcagcttacacgagcaaagtggagctgcaggccaaggtggatgccctggatggagaaatcaagttcttcaagtgtctgtacgagggggagactgctcagatccagtcccacatcagcgacacgtccatcatcctgtccatggacaacaaccggaacctggacctggacagcatcattgctgaggtccgtgcccagtatgaggagatcgcccggaagagcaaggccgaggccgaggccctgtaccagaccaagttccaggagctgcagctagcagccggccggcatggggatgacctgaaacacaccaaaaatgagatctcagagctgacccgtctcatccaaagactgcgctcggagattgagagtgtgaagaagcagtgtgccaacctggagacggccatcgctgacgccgagcagcggggggactgtgccctcaaggatgccagggccaagctggatgagctggagggcgccctgcagcaggccaaggaggagctggcacggatgctgcgcgagtaccaagagcttttgagcgtgaagctgtccctggatattgagatcgccacctaccgcaagctgctggagggcgaggagtgcaggatgtccggagaatataccaactccgtgagcatttcggtcatcaacagctccatggccgggatggcaggcacaggggctggctttggattcagcaatgctggcacctacggctactggcccagctctgtcagcgggggctacagcatgctgcctgggggctgtgtcactggcagtgggaactgtagcccccgtggggaagccaggaccaggctggggagtgcaagtgaattcagggactcccagggaaagaccttagctctaagctcacccaccaaaaaaaccatgagataaaagtgcaacacagcccatttcccagtagtctgccttgccctggcagactgctccggactcttctaggaaattcctctgtctcatttgtcctcatctccttcttgctttgctttgctgtggacctctcctccttctccttgacctctctgcctcagtctttgttaatgttgaatcaggatttgagagctggagcccatctttctgcctccatccaaagaggccttttaactcagcctccccttctggaagaagacttggccttttctctgcctgcatgtccctgtgcagaggaaggctgtctctcaagggtaaccccaatctgcctgtgctgctctttcataccctgtctcagtaactatttggccatgtgctccctgggtacacaagttttcagatctactgatagacctgcaggaactctctcatgttagagcaatactggctcaggcaaaacacctggtgggaagttgtatcttgtatagccactgcatattacatagccaggagtaccccttgaggctaattctaccaaccaagggatttgtgctcttcatctgtgggtacttgtccttgtttaggcctcacctccctgctcctgtgtcttaccaataaacttataaagccca

SEQ ID NO: 15243 - DNA, 2788 bp, Homo sapiens
ccttggagactgcttttctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaagtggagattaaccggcgcacgacagcagagaatgagtttgtggtgcttaagaaggatgcagatgcagcctacgcagtcaaggtggagcttcaggccaaagtggactcactggacaaagaaatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaagatccaggagctgcagctggcagccagtcggcatggtgacgacctgaaacacaccaggagcgagatggtggagctgaaccggctcatccagaggatccggtgtgagatcgggaatgtgaagaagcagcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggatgtctggtgagaatccatcctctgtgagcatctctgtcatcagcagtagcagctacagctaccaccaccccagctctgcgggtgttgaccttggggccagcgctgtggcaggcagctctggcagcacccagagcgggcagaccaagaccacagaggcgcgagggggagacctcaaggacacccagggcaagagcaccccagccagcatcccagcaaggaaagccacccgctagacccatggcctcacccacctcagcacttggaagaagaggtgactttgccacccccaaaggtgtctgccacacccaagttcccaggccctgagttttaaaactgtctgtagtacactcaactgtctgcatcgtggtttagcttttactttcaagctctgattgacacagtcaccttccctgtttccttaggtcccatgtggactaacgacttctcattttcctcgctgcctttggctggcaggaggctttggaggcacaagccattataaccttcttggccctaaggaagctgtgatcatccctagaaagagggaaggagcaggagacgacaggggaggggctggtttgttctgtgcttaggccaagttagctactgtctgagaggttttacatcccctgccagcatggtggggtgacacgagacctgtaagcaggtggtgagaagttagacagcctttacttgctccatcagaaacaactttgcaggatgacgccaatatttaggacaccacgtgtacatctgtagaccaccagctgcacccatctccacaaagccaagtgaaggtgtattggggattctctgccagcctgtgtcacccacccacctccttcattatcagcaatagctaccatcatttgtcaagcacctactagatgccagacaccctacacatattgcctcctgttctcatccattcctgcaaagaagatgcaatgagcatccttggaacagactgggagcctgatcccaagaggctgctgaactggccccagtcacccacctatgtgccagagtcaggcctggccgacacaaggatctatgctttttctgtggtgtgtcactgcctttttaacaaaagggctgtcaaagtcaccattctttttgatgagggcagcgtaattacattgccttttgtcaggactgtgggtatgtgatttgtcttccacagtctctctggggctgtgtcctacatagcttctgactctcaatttttggtgccatgagctgagctcagtgagtggagctggcttttctgtcgctgagtgctactgcctagtccagatgtcgtggctcagggtgtaaatattcctaagaatggcagcatctatttcctcttttgtttgaattaaagactctgaatttctgctg

SEQ ID NO: 15244 - DNA, 2324 bp, Homo sapiens
agccagtggcccttacaccatttcccgagggatgccgagtgtgagctcagggttggcggatgcccagggaatgccatcagaaggccctctccactagcagtgccccgcccccacaggatgctcataaaagccacgagaccagggctctccagccacctgtcttctccactgcctgtaccagcccacctcaggtgccttctcgccggccttcctcacccaccatgtctcggcagtcctccatcaccttccagtctggcagccgcaggggcttcagcaccacctcggccatcaccccggcagctggccgctcccgcttcagctctgtctctgtggcccgctctgcagcagggagtgggggcctgggaaggatcagcagtgctggggccagctttggaagccgcagcctctacaacctggggggtgccaagcgggtctccatcaatgggtgtggcagcagctgccgaagtggctttggtggcagggccagcaacaggtttggagtcaacagtggatttggctatgggggtggagttggaggaggcttcagtggccccagcttccccgtgtgtccccctggaggcatccaagaggtcactgtcaaccagagtctcctgactcctcttcacctgcaaatcgaccccaccatccagcgggtgcgggccgaggagcgcgagcagatcaagaccctcaacaataagttcgcctccttcatcgacaaggtgaggttcttggagcagcagaacaaggtcctggagaccaagtgggccctcctgcaggagcagggctccaggactgtgaggcagaacctagagcccctctttgattcctataccagtgagctccgacggcagctggaaagcatcaccaccgagaggggcaggcttgaagctgaactgaggaacatgcaggatgttgtggaagatttcaaagtcaggtacgaagatgaaattaacaagcgcacagctgctgagaatgaatttgtagccctgaaaaaggacgtagatgctgcctatatgaacaaggtggagctggaagccaaggtcaaatctctgcccgaggagatcaacttcatccactcagtctttgatgcagagctgtcccagttgcagacccaggtcggtgacacatccgtggtgctgtccatggacaacaaccgcaacctggacctggatagtatcatcgccgaggtcaaagcacaatacgaggacattgccaaccgcagccgggccgaggctgagtcctggtaccagaccaagtacgaggagctgcaggtcaccgcaggcagacatggggatgaccttcgaaacaccaaacaagagatctctgaaatgaaccgcatgatccagaggctgagagctgagattgacagcgtcaagaagcagtgttccagcttgcaaacggccattgctgatgcagagcagcggggagaactggctctcaaggatgcacgggccaagctggtggaccttgaggaggccctgcagaaggccaagcaggacatggctcggctcctgcgtgagtaccaggagctgatgaacatcaagctggccctggacgtggagatcgccacctaccgcaagctgctggaaggcgaggagtgcaggttgagtggagagggagtttctccagttaacatttctgtggtcacctctactctttccagtggctatggaagcggcagcagcattggaggtggaaacctgggcctcggtgggggcagcggctactccttcaccaccagtggtgggcatagcctgggtgcaggcctgggaggttctggattcagtgccaccagcaaccggggcttagggggcagtggttctagcgtcaagtttgtctccaccacatcctccagccagaagagctacacgcactaagagagccccatggctccctctaccctgccttgaggcctgtttgcagtcacacctggacaccagggtcctcctccttcctctctccttgtaaggtgcacctgtgctgctgggagcctggagtactggctatacccattcccaggcctaagccagcctctccctcctgacagtgcccagactgccagcagcacccgtctgttacacatgtgaaaccaaagcctgctctctcctaaggctctcattcagcctatcttgcgaggcccgggcagctggaaagtcctcctccagctccacctccctccctccctccagatgcagaggctggggagtctctcaatgccaggttgtcacccacctgtctcatagtgtttataagtggcctgctgggagtgagtgctccctctgttccctccctggaatgtgtctattaaatgcatgtgtcacctg

SEQ ID NO: 15245 - DNA, 3305 bp, Homo sapiens
tgcctgcttctctggatgctccagcaaacatgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcaccggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaaggtgcgattcctggagcagcagaaccaggtgctacaaacaaaatgggagttgctgcagcaggtgaacacctcaactggaaccaacaacctggagcccctcttggagaactacatcggtgacctgcggaggcaggtggatttgctcagtgcggagcagatgcgccagaacgcggaggtcaggagcatgcaggatgtcgtggaggactacaagagcaagtatgaggatgaaatcaacaagaggactggcagcgagaatgactttgtcgtcctgaagaaggatgtggatgctgcttatgtgagcaaagtggacctggagtccagggtggacactctgactggggaggtcaatttcttgaaatatttatttttgacggagctgtctcaggtgcagactcacatcagcgacaccaacgtcatcctgtccatggacaataaccgttccctggacctggacagcatcatcgatgcagtgcggacccagtatgaactgattgcacagaggagcaaggacgaggccgaagccctgtaccagaccaagtaccaggagctccagatcacggcagggagacatggagacgacctgaagaacagcaagatggagattgcagagctcaaccgcaccgtccagaggctgcaggcagagatcagcaacgtgaagaagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggatgtcaggagagctgcagagccatgtgagcatctccgtgcagaacagccaggtgagcgtcaacggcggcgcgggaggcggcggcagctacggctcaggaggctacggcggcggcagcggtgggggctatggcggcggaagaagctaccgcggaggcggggcacgaggcaggagtggaggcggttatggcagcggctgcggcggcggtggcgggagctacggagggagcggcagaagcggccgcggatcctcgcgcgtgcagatcatccagacctccaccaacacctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtcattgttatcattcctctgcctccaagtagaatgcccttatgccccagttcaagccactgcagctaagtattaatccccagtgctaaaagataccaggcatctagtttagcaatggagggaaacagaaacagcctgtagagagcatcgacaaggcgcataatggagagttggtatctcaaccccaagctccctttgctgtacctgggctgctctgtgaacaagaatccacgcccccctgccctgctggggaccacataatgatccctttgggggaagttgctgattgcagggcaagctagcttggtaaggaaaacctctgcaccagcggcctattcctgcctcttggtccatagcctcatacactcatgttgatggatagtatagatttgctgcccacaccagatatctgtaaggcatcactgtcctgattctgaacctctgtttcaggaagcattctcccctgtgtaaacaactcaaggtggaagtatttcagagggcatagggtcatgaatccttacccaaaggaagcctgttttagcagtggatgcaggagttgatgaacagacaagcaagttctgcttctgtcctgtttcctcctgacagctccattcttttgaagcctgacccttcctaagctctgcatcataaccactctgagaattgccccattgggtgggcatgtgaagcccagctctgttccatccaggtgcctcgggcctgaggagtctgaggatctgacttgggtcttggaagggttccaaccccaagtcagtcaggaagctgcccatttttttgcaaggcattttaatgccctttcccagacctctctagtccctcctgccttctgttctctgtagctgtgagccctttgtgagaatatgactcttaattttgaatcttatgtaagaggcttgagatgtgctggagagggcaggaagaggaaagtatcaggccttgagagagggaatgtagctttgcttctatgatctggagtcaccttcacttgctagctgagtcctaacacaacttccaagtccatgattctcttggggcattggatgggctcagtgtgggtctcttaggctgttcttgtgacttcatcatttcctggttcaaagttgtactgtcaaggggcagcatttctggtatttctataataaatttttctgtgatctcaaa

SEQ ID NO: 15246 - DNA, 2212 bp, Homo sapiens
tgcctgcttctctggatgctccagcaaacatgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcaccggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaagagaaaggaaccttggggtcatcagtgtctcagatgctccgaaacaccatttccttacgttggcatggataaattgagtgtggagggtgcgattcctggagcagcagaaccaggtgctacaaacaaaatgggagttgctgcagcaggtgaacacctcaactggaaccaacaacctggagcccctcttggagaactacatcggtgacctgcggaggcaggtggatttgctcagtgcggagcagatgcgccagaacgcggaggtcaggagcatgcaggatgtcgtggaggactacaagagcaagtatgaggatgaaatcaacaagaggactggcagcgagaatgactttgtcgtcctgaagaaggatgtggatgctgcttatgtgagcaaagtggacctggagtccagggtggacactctgactggggaggtcaatttcttgaaatatttatttttgacggagctgtctcaggtgcagactcacatcagcgacaccaacgtcatcctgtccatggacaataaccgttccctggacctggacagcatcatcgatgcagtgcggacccagtatgaactgattgcacagaggagcaaggacgaggccgaagccctgtaccagaccaagtaccaggagctccagatcacggcagggagacatggagacgacctgaagaacagcaagatggagattgcagagctcaaccgcaccgtccagaggctgcaggcagagatcagcaacgtgaagaagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggatgtcaggagagctgcagagccatgtgagcatctccgtgcagaacagccaggtgagcgtcaacggcggcgcgggaggcggcggcagctacggctcaggaggctacggcggcggcagcggtgggggctatggcggcggaagaagctaccgcggaggcggggcacgaggcaggagtggaggcggttatggcagcggctgcggcggcggtggcgggagctacggagggagcggcagaagcggccgcggatcctcgcgcgtgcagatcatccagacctccaccaacacctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtca

SEQ ID NO: 15247 - DNA, 1778 bp, Homo sapiens
agaaactcacacaccttgacaatctgtctgtccgtctgcagctgcgtgactgtctgtctctgccatgtctctctccccatgccgggcccagaggggcttcagcgctcgctcagcctgttctgctcgctcaaggggccgcagcaggggaggcttcagcagcaggggcggcttcagcagcaggagccttaattcctttggggggtgcctggaaggctctcgtgggagtacctgggggtcagggggtaggctgggggtgcggtttggggagtggagtggtgggcctgggctctccctgtgccctccggggggcatccaagaagtgaccatcaaccagaatctgctgaccccactgaagattgagatcgatccccagttccaggtggtgcggacgcaggagacccaggagatcagaaccctcaacaaccagtttgcttccttcattgacaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgtt

SEQ ID NO: 15248 - DNA, 2554 bp, Homo sapiens
gttcagagtgtcatggaaggtcatgaggcttcccctgcccaggttgggcagggggacaggggaaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgttctgaatgctctaagtgcttgcacacctcacccagcaaaacaaaagctgtgtggctccccagcttcctctcctcggaaggcaattgtggcatatctgtgtccagacgtgttctattggtatctcactccacatcccagccactctatcaagggatccttcaagctctccagtgtgttccttggggtgccctccatctcccacaactccactgatgttttagctgtgcttgtagctcacttcctcatcaactgcctgttttaagaggttctagtcctgactggggcagcccccttccttcttgttcctccttcttcctgactgtgcaccaaaattttctccttttaggaaccttctctaattcccatgtctaaactactgggcccttcctgtccctggcagtctggctgcacctgttgctgtcctgggtgctatgtctgtctggctctggtaagggactcagcttctctattagcctggcactcctgcatccaggatgaggatgtgctcagcttgtgcctgggggctctgatggagattggggttcaaactctgcccctacccccttatctgttggctctcatcttatccttgggcaagtgtgaacatgaggctggaaacttctcctccttcctctccttcaggaagctctgcaggaagccaggagtgtgggaatcaggtggggtgccaggaggggctggaaggatcaccttttctacacacccccagcagcctcatgggtgcctgcagttgctctttccccattctcgctttccagacccaggtgggggacctggctcaaccccaaactccatagtctgggctgcaggaggtcacactacgcctctccttgctttagagggagggcagacctttcctcagattcatgaatcgctccatccaaattatgcaagaaggcttttcagctttgtgtgaaggagaccagagccggtgaggatgtggcttgaatcccagctctgctgtttcctagtggtgtgaccttgatcaagcagcttgacctcttcagttacctcatctgtaaaaagagattaataataatatgtacctcacagggctgtgtggcgacagtgccactaggatcccagaaggaaactaaattcatccaaggtagttcaattaaattgactttttgaaaaagta

SEQ ID NO: 15249 - DNA, 1700 bp, Homo sapiens
aactcacacaccttgacaatctgtctgtccgtctgcagctgcgtgactgtctgtctctgccatgtctctctccccatgccgggcccagaggggcttcagcgctcgctcagcctgttctgctcgctcaaggggccgcagcaggggaggcttcagcagcaggggcggcttcagcagcaggagccttaattcctttggggagtggtgggcctgggctctccctgtgccctccggggggcatccaagaagtgaccatcaaccagaatctgctgaccccactgaagattgagatcgatccccagttccaggtggtgcggacgcaggagacccaggagatcagaaccctcaacaaccagtttgcttccttcattgacaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgc

SEQ ID NO: 15250 - DNA, 2068 bp, Homo sapiens
gccctctcatcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgttggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggctgcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttgggtgacttgggggtgaccttttgaccaccgagaggaggctgaatttctcaagccattaggagagagagaaattgggagtggtccccaaagacccttcaacctccccagtcccccaccagacccaccctctccctgaatctacccacatcccccttccctgtctgtgtctcaataaatggtgcaactgca

SEQ ID NO: 15251 - DNA, 3894 bp, Homo sapiens
cccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcatttgccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctggtacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaatta

SEQ ID NO: 15252 - DNA, 3859 bp, Homo sapiens
cccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcatttgccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctggtacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaatta

SEQ ID NO: 15253 - DNA, 1929 bp, Homo sapiens
cattggagtttccatcaggactccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatcctcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 15254 - DNA, 1505 bp, Homo sapiens
actccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatcctcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaagtggggtcttgcggcagcagctgccggaaatgttag

SEQ ID NO: 15255 - DNA, 1875 bp, Homo sapiens
acaggcccttggttccatcctctgccatctactccactgttcagacacctcctaacctccgtcatgacctgtggcttcaactccataggctgtgggttccgccctggaaacttcagctgtgtctctgcctgcgggccccggccaagccgctgctgcatcaccgccgccccctaccgcggcatctcctgctaccgcggcctcaccgggggctttggcagccacagcgtgtgcgggggcttccgcgccggctcctgcggacgcagcttcggctaccgctccgggggcgtgtgcggacccagccccccatgcatcaccaccgtgtcggtcaacgagagcctcctcacgcccctcaacctggagatagaccccaacgcgcagtgcgtgaagcaggaggagaaggagcagatcaagtccctcaacagcagattcgcggccttcatcgacaaggtgcgcttcctggagcagcagaacaagctgctggagacaaagctgcagttctaccaaaaccgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtatgaagaagaagtagcacttcgagccacagcagagaacgagtttgtggctctaaagaaggatgtggactgcgcctacctccgcaagtcagacctggaggccaacgtggaggccctgatccaggagattgacttcctgaggcggctgtacgaggaggagatccgcattctccaatcccacatctcagacacctccgtggttgtcaagctggacaacagccgggacctgaacatggactgcatcgttgccgagatcaaggcacagtatgatgacattgccacccgtagccgggctgaggccgagtcctggtatcgcagcaagtgtgaggagatgaaggccacagtgatcaggcacggggagaccctgcgccgcaccaaggaggagatcaacgagctgaaccgcatgatccagaggctgacagccgaggtggagaatgccaagtgccagaactccaagctggaagctgcggtggcccagtctgagcagcagggtgaggcggccctcagtgatgcccgctgcaagctggccgagctggagggcgccctgcagaaggccaagcaagacatggcctgcctgatcagggagtaccaggaggtgatgaactccaagctaggcctggatatcgagatcgccacctacaggcgcctgctggagggcgaggagcagaggctgtgtgaaggtgttgaagctgtgaatgtctgtgtcagcagctcccggggtggggttgtgtgcggggatctctgcgtgtcgggctcccggccggtgacgggcagcgtctgcagtgccccctgcaacgggaacctggtggtgagcactggtttgtgcaagccctgtggccagctgaacaccacctgtggagggggctcctgcggccaggggaggcattaagtggcccaaaagagagccaggggagccccttctgcctgccagacgtgccactgccccaccaccagctgaaaacagcagcacatcgctggcttttccccttgtgttctgagaatacaccatcggctcattcccaccagcggctcctccccacctttcatcccactggaaaggggcctgtggctggggaatagacccattccttcccctgtctcagccttcagcccctcccggggagaagggccttgcttccctggaagaagcactgtgagactgttccccctgcctctctggcctcttgtctccccttttccaataaacttggggacctgc

SEQ ID NO: 15256 - DNA, 2447 bp, Homo sapiens
agaaggatcctgagcctcgcactctgccgcccgcaccaccttccgctgcctctcagactctgctcagcctcacacgatgtcgtgccgctcctacaggatcagctcaggatgcggggtcaccaggaacttcagctcctgctcagctgtggcccccaaaactggcaaccgctgctgcatcagcgccgccccctaccgaggggtgtcctgctaccgagggctgacgggcttcggcagccgcagcctctgcaacctgggctcctgcgggccccggatagctgtaggtggcttccgagccggctcctgcggacgcagcttcggctaccgctccgggggcgtgtgcggacccagccccccatgcatcactaccgtgtcggtcaacgagagcctcctcacgcccctcaacctggagatcgaccccaacgcacagtgcgtgaagcaggaggagaaggagcagatcaagtccctcaacagcaggttcgcggccttcatcgacaaggtgcgcttcctggagcagcagaacaagctgctggagaccaagtggcagttctaccagaaccagcgctgctgcgagagcaacctggagccactgttcagtggctacatcgagactctgcggcgggaggccgagtgcgtggaggccgacagcgggaggctggcctcagagctcaaccatgtgcaggaggtgctggagggctacaagaagaagtatgaagaggaggtggccctgagagccacagcagagaatgagtttgtcgttctaaagaaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctcagggacaagaccagtcccccagcgtggtggtcagcacggaagctccaccttctgggtggaggcgccatcctaaccatccagccaggccacccacaacccgagaatcagggagaaagtccctccccagcagccccctcctcctggctgggaagaatggtcccccagcaagcacttgcctgttcattcctgttcatgttttgcttctctctcagactgccttcctgcttctgggctaacctgttccagccaggctcctcatgtgacctcgcagttgagaagcccattatcgtggggcatccttttgcctacagcccctggttagggcactttggacaggtcttgctattcagtgaacctttgtacatttcaaagaagactccatggctgctccagatgcccccttgctgggtgcaggtggggactgtccaatgcagagctggcgggacagagagttaagccacttcctgggtctccttcttgtgactgtctatgggtgcattgccttctgggttgtctcgatctgtgtttcaataaatgccgctgcaatgcaa

SEQ ID NO: 15257 - DNA, 1387 bp, Homo sapiens
acagatgattttagacttgggggaaggaatgtgcattcctaaccccatctcagaggcagaaggactgcggcggaatgaagccaggctaggacaagggctggcccatgaataatacaaaaaatagatcctggaggggccaagacaacatctggaggggattaatcccttttcaatccccggaagaacttgcccaggagttgggatggtattcaaggtccagtttctcagctccagaccttctctctcccacacccaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctca

SEQ ID NO: 15258 - DNA, 1868 bp, Homo sapiens
tttggtgctcaagagaggcttggaggagaccacagttctttctccatgtgtgaggaattaaaggcaactgtgcagaaacacacgcagagcctgaagcccagcaaggaggatctgaacaggcttaatcaggccatccagtggctgacggtggaggtgggcagtgctgagagtcagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatt

SEQ ID NO: 15259 - DNA, 2287 bp, Homo sapiens
ccctgcacttgggagccggtagcactcctatcactgcttctcaacccgtgagctaccagctgtgtcatgagctgcagacagttctcctcgtcctacttgagccgcagcggcgggggtggcgggggcggcctgggcagcgggggcagcataaggtcttcctacagccgcttcagctcctcagggggcggtggaggagggggccgattcagctcttctagtggctatggtgggggaagctctcgtgtctgtgggaggggaggcggtggcagttttggctacagctacggcggaggatctgggggtggttttagtgccagtagtttaggcggtggctttgggggtggttccagaggttttggtggtgcttctggaggaggctatagtagttctgggggttttggaggtggctttggtggtggttctggaggtggctttggtggtggctatgggagtgggtttggggggtttgggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagccccagctgagcatccccagatgggcagactcccgatgaagcctgcttattggatcctgacatcaggaatagctggcaacaagcccctgtgcccgtttgggactgaactgacttggcatatgtgcctctggctttccattggcttccaaccctgcttggctttgatgccttcagggttggggagacagacctctttcctctctctggcctggggtgctctcacaccctgcacgatcttgactataataaagcttccctactgc

SEQ ID NO: 15260 - DNA, 903 bp, Homo sapiens
aataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatg

SEQ ID NO: 15261 - DNA, 504 bp, Homo sapiens
atggcctgctgtcagaccagcttctgtggatttcccagctgctccaccagtgggacctgcggctccagctgctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttga

SEQ ID NO: 15262 - DNA, 909 bp, Homo sapiens
gcaagctacctgcagccctctgtctgacatcatgtccttcaactgctccacaagaaattgctcttccaggcccattggaggacgctgcattgttccagtggcccaagttaccacgacttccaccactgatgctgactgcctgggcggcatctgtttgcccagttccttccagactggctcttggctcctggaccactgtcaagagacctgctgtgagcccactgcttgccagccaacctgttaccggcgaacttcatgtgtctccaacccttgccaggtgacttgctctcgacaaactacctgtatttccaacccctgctcaactacctacagccggccgctcacctttgtctctagtggatgtcagcccctgggaggcatctccagtgtctgccaaccagtgggcggcatctctactgtctgccaaccagtgggaggagtctctactgtctgccagccagcctgtggggtctccaggacgtatcagcagtcctgcgtgtccagctgccgaagaacctgctaagtgtgtaggagccagtgagcgaatcaagactccacgacctgccagctgtttccaggatcttccagcatgctgcttgtccctgaatagctcttcatagctgacccttcttgtgaccgcctgactgctggctactatccatgcacacgctgtctttagcactctaaaatttttctggccagccctaagcttgttttaagggttgctcactggtgctgtgtatgcctctggatgtgtccagaagctttaccatccacaccccagtctctgatgcttttgacatgttttcaccttgctgctgtatctcctggcctctgcttttgtgtctcacaaaaacagagcttgtctcaccatgtatttctcaataaacctgcattagttggcattgc

SEQ ID NO: 15263 - DNA, 966 bp, Homo sapiens
aagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgc

SEQ ID NO: 15264 - DNA, 449 bp, Homo sapiens
actcagaaacctctcttaacacagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgatcgcttaagaatgaaagggga

SEQ ID NO: 15265 - DNA, 942 bp, Homo sapiens
cctctacctgctccaccctcaatccaccagaaccatgggctgttgcggctgctccggaggctgtggctccagctgtgggggctgtggctccggctgtgggggctgtggctccggctgtgggggctgtggctctggctgtggaggttctggctccagctgctgtgtgcccgtctgctgctgcaagcccgtgtgctgccgtgtgccaacctgttcctgctccagctgtggcaaagggggctgtggctcttctgggggctccaaggggggctgtggctcctgtggaggctgcaaggggggctgtggctcttgtgggggatccaaggggggttgtggctcctgtgggggctccaaggggggctgtggctcttgtgggggatccaagggtggctgtggttccggctgtgggggatgtggctccagctgctgtgtgcctgtctgctgctgcaagcccatgtgctgctgtgtgccagcttgttcctgctccagctgtggcaaagggggctgtggctcctgtgggtgctccaagggggcctgtggttcttgtgggggctccaaggggggctgtggctcctgtggaggctgcaaggggggctgcggttcttgtgggggatccaaggggggttgtggctccggctgtgggggctgtggctccggctgcggtgtgcccgtgtgttgctgttcctgttccagttgtggctcttgcgcggggtctaagggaggctgcgggtcatcctgctcccagtgcagttgctgtaagccctgctgctgttcctcaggctgtgggtcatcctgttgccaatccagctgctgcaagccctgctgctcccagtccagttgctgtgtccccgtgtgctgccagtgcaagatctgatttctggctttgcaggactcttaccatggccaggcattcctgcccagcctttacctccttttcctggcacc

SEQ ID NO: 15266 - DNA, 1188 bp, Homo sapiens
gaattccacaaggaaatcatctcaggaggaagggctcatacttggatccagaaaatatcaacatagccaaagaaaaacaatcaagacatacctccaggagctgtgtaacagcaaccggaaagagaaacaatggtgtgttcctatgtgggatataaagagccggggctcagggggctccacacctgcacctccttctcacctgctcctctacctgctccaccctcaatccaccagaaccatgggctgctgtggctgctccggaggctgtggctccagctgtggaggctgtgactccagctgtgggagctgtggctctggctgcaggggctgtggccccagctgctgtgcacccgtctactgctgcaagcccgtgtgctgctgtgttccagcctgttcctgctctagctgtggcaagcggggctgtggctcctgtgggggctccaagggaggctgtggttcttgtggctgctcccagtgcagttgctgcaagccctgctgttgctcttcaggctgtgggtcatcctgctgccagtgcagctgctgcaagccctactgctcccagtgcagctgctgtaagccctgttgctcctcctcgggtcgtgggtcatcctgctgccaatccagctgctgcaagccctgctgctcatcctcaggctgtgggtcatcctgctgccagtccagctgctgcaagccctgctgctcccagtccagatgctgtgtccctgtgtgctaccagtgcaagatctgaggctctagtgggaaacctcaggtagctcctgaagatctgtgctttccaacaagtgactacccttgaagcacatccccttctggatctgaaaagagcccttggctcagggcgtctttttccagcccctgaggaaatggaatgaaccactccctgcccattccctataagaatatcccaagacccaggcaattttgcccctctttcccacatgcccccatatgtctgagccaaactgcactgggggctgccctcatgccaagcaagagcctggaattccccttcttgataattccatgggagacagcaaacccttctttcctttgcctgccaggagcttcacgacatttgcagatggatgtcctgcaacccaaatgatcacatgtatctatggaaatccaaaatgcatctgggtgcagcactaaataaattctccatccctc

SEQ ID NO: 15267 - DNA, 2523 bp, Homo sapiens
agcctgaaggactgcttgcctgtgaggagggtcactcttgactggctgcatcaggaccatgtgtgaccagcagcagatccagtgccgcctgccgctccaacagtgctgcgtcaagggtccctccttctgctcctctcaatccccctttgcccagagccaagtggtggttcaagccccttgtgagatgcaaattgtggactgccctgcatcatgcccagttcaagtttgccaggtgtcagaccaggctccatgccagtctcagaccacacaggtgaagtgccagtctaagaccaagcaggtgaagggccaggctcaatgtcagtctaagaccacccaggtgaagggccaggctgcatcccaatctcaaacttcctctgttcaaagccaggctccatgccaatctgaggtgtcctacgtgcagtgcgaagcgtcacaacctgttcagacttgcttcgtagaatgtgctccagtttgttatacagaaacttgttatgtagaatgcccagtccagaactatgtaccctgtccagctcctcagcctgtccagatgtatagagggcgtcctgcagtgtgccagcctcagggaagattctccacccagtgccagtatcaaggctcctatagcagttgtggcccccagtttcagtcaagggctacctgcaacaactacaccccccagttccagttgaggccttcctacagcagctgtttccctcagtatcggtcccggacttcatttagtccctgtgtgccccagtgccagacccagggctcctatgggagcttcactgaacagcaccgctctcggagcaccagcagatgccttcctcctcctcggcggctgcagcttttcccccgcagctgttccccaccaagacgttttgagccctgctccagcagctacctgccactaagaccctctgaaggtttccctaactactgcaccccaccccgccgctctgaacccatatataacagtcgctgtcctcgccgccccatttcaagctgctctcagagacgtggccccaagtgccgaatcgagatttcctccccgtgctgccccaggcaggttcccccacagaggtgtcctgttgagattcctcccatcagacgccgctcccagagctgtggcccgcagccctcctggggcgcctcctgccctgagctgaggccacacgtagagccacgtccactcccaagcttctgtccaccacggcgtcttgaccagtgtccagagtcaccactgcagcgatgtccacctcctgctccacgtccacgtctgcgcccagaaccatgcataagtctagaaccacgcccgcgtcctctaccacgacaactttcagaaccttgtttgtatccagaaccacttccagcactacgtccaacaccgcggccagttccccttcctcgcccagggcagtgtgagattccagagccacgtccatgcctgcagccctgtgagcacccagagccttgtccacgaccagagccaattcccctgccggcgccctgcccaagcccggagccctgcagggagacttggcgcagccccagcccatgctggggcccaaatccagttccatacccaggagacctaggctgtcatgagtctagtccacaccgcctagacaccgaagctccctactgtggcccatccagttacaaccaggggcaagagagtggtgctggctgtgggcctggtgatgtgtttccagagcggaggggtcaggatggccatggagaccaaggcaatgcctttgctggagtgaaaggggaagcaaagagtgcttatttttaaaggaaaggtgactgagataaccctctctcctgctctgaaaatgttgttcctcctattccacaatttccagtacgctcttgtttgaatctctccaaagatattcagagactccctattacgaaggtgatgtccaaactcctttgcctatcatccaaagatccacacctgggtctcagatgcctctccagcctcacgtgtcactcctcgcccgtacgcatcctcggctctagccagaccagtctggccactgggcacagcttgggtgttccccaggccatactttagatgtccctgcctccaagcctctgctcactcttccccactctgcctggaccacttctctcctcctccccagcttctgaaatccaccccatctttcagtgcctctcccttggagccttctttgcttgttcccactcacaagaacctgtgccgacttcctagaactcactgcatcccccgcactacttggtaactgcctggtgacatctcttgaattgttatttcactttgcaggcatgtcttccttatctgcccaactaggttgtaaactcccaactgagtggagtcggagaatctctaaatctcagtgtctatcctggggctggctgttgcttagcaaggcttgtgggttggcagcttgaaccatgttctgtcctgatgctcaactgcaggaactgaggtgagaggaggccatgtgacaataaagatcattatgtactcac

SEQ ID NO: 15268 - DNA, 2162 bp, Homo sapiens
gaagaagatccaagaaggctgaggtaagcagtcttctgaagccctgtcaaagtggaaacaatagatcaaaggtgttcatggtgactgggacgagtaggtttcactgtttctcatagacgacttgacagcttaaagtaaaaacaaattattttcgtcaaagtttttttttttctcttaactgatttttagcaaacctcagactgagacacaggactcaacggtgtattcctggaaggcaaggtgctataatggcaggcacaatctgtttcatcatgtgggtgttattcataacagacactgtgtggtctagaagtgtgaggcaggtctatgaagtacatgattcagatgattggactattcatgacttcgagtgtcccatggaatgtttctgcccacccagttttcctactgctttatattgtgaaaatagaggtctcaaagaaattcctgctattccttcaagaatttggtatctttatcttcaaaacaacctgatagaaaccattcctgaaaagccatttgagaatgccacccagctaagatggataaatctaaacaagaacaaaataaccaactacggaattgaaaaaggagccctaagccagctgaagaagttgctcttcttatttctggaagataatgagctagaggaggtaccttctccattgccaagaagtttagaacaattacaattagctagaaataaggtgtccagaattcctcaagggacctttagcaatctggagaacctgacccttcttgacctacagaacaacaaattagtggacaatgcctttcaaagagacacttttaaaggactcaagaatctcatgcagctaaacatggccaagaatgccctgaggaatatgcctccaagattaccagccaatacaatgcagttgtttttagacaacaattccattgaaggaataccagaaaattattttaatgtgattcctaaagtggcctttttgagactaaatcacaacaaactgtcagatgagggtctcccatcaagaggatttgatgtatcatcaattctagatcttcaactgtcgcacaatcaactcacaaaggttccccgaatcagtgctcatctgcagcaccttcaccttgatcataacaaaattaaaagtgtgaatgtctctgtaatatgtcccagcccatccatgctgcctgcagaacgagattccttcagttatggacctcatcttcgctacctccgtctggatggaaatgaaatcaaaccaccaattccaatggctttaatgacctgcttcagacttctgcaggctgtcattatttaaacacattctcaccaaatctaaaattagtttaatgagctgtttctgacatgaaatgtggttaccattaataggtttaggacacaagtcatattccccattgctctcggccaccattttcatttgtgcagtgtattttttctattcaaagatgcttttgccagttacatgcatcacagcctgcattaatttgcttttcttttaattaataaaacagacacagagttaagatagtttatcaactcaaagatagttttattttggtctcttccatagcttattaacactaaagaaaacaattacattcttatacaataaaaaggacacatttgtgtatgtttaaaattacttatgcagataccgtaatttacagtataaatgtaataatcaaacaggaggataacgacctgaagaaaatgagaaaataaaatatttcttaattgtaatcataataaaacaattgcagattgctaagtagctgttggtggtacaagtttgatatttagcttgagaatgggtatggaatgaatcaaatacttcatcactaaagaattcttgttatttaatatcaaataatgaaacagcagtcacttctagttcattaccatttcttgtagctgttgtttttagatatagtccactgcattcttataagttctaaattttatgtttattataatgcatttcttgtggaatcttagtgttttaacatttgaaatccacttaaactgcaaattgttctttatatttgattgtgttttttggattttctaaataaaaatattgaatgctttctaacaaaacagaatatttcaaagaaattagcaagcttcattaaagaacatgttttaataaaaa

SEQ ID NO: 15269 - DNA, 2397 bp, Homo sapiens
gcagatgcgaggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattaaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctc

SEQ ID NO: 15270 - DNA, 2411 bp, Homo sapiens
cggggccgccgcgaccgcgggcttcaggcagggctgcagatgcgaggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattaaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatg

SEQ ID NO: 15271 - DNA, 1977 bp, Homo sapiens
gagtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 15272 - DNA, 1134 bp, Homo sapiens
gcgcgcctcgcgcggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaa

SEQ ID NO: 15273 - DNA, 1430 bp, Homo sapiens
ggcggaagaggcgggtccagggcggtgtaattaaggcgcggagcccagaccctcctgctacagtgcctcgggctttcctggaggcgggcggcgggatgctgctccgttctccgggtcctctcctccggttcttgtcgtttggtcacgccctcagttcagtcggttattggaaaacgatcaaggcccaaagatggtttacgtggcgttgtggatgttatcaccgttgtttggtgaccgagcctggagcttgagccctgggacgtcttgccagccgcatgtggtcccgtgcccacttctcgcggtggcgcgttaatccacctagactgtgcattggtccagtctgggttgaccccgacccgaagtggccctttccttcgcgtcctgaacttcgcttctccgtcggtgtctggtctcttcccgccggcgggctctgcggtggcgggaggagctgtactactcgtgccttagcgcacccttactttcccaggccagaaacgcgaaatgctgtcggccttccagaggctgttccgagtcttatttgtgattgaaacagtctcagaatacggagtcctgatcttcatttatggatggccctttctccagacccttgcgatgctcctgatcgggacagtgtctttccacctttggatccgcagaaatcgagagagaaactcaaggagcggaaagactagatgccgatccaaaaggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaa

SEQ ID NO: 15274 - DNA, 547 bp, Homo sapiens
cggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgag

SEQ ID NO: 15275 - DNA, 2243 bp, Homo sapiens
agagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagcgcaagtggccaccggagggggtccaggagctcccccaggcttcctggccccccccacggtgttccagcccctcctctcttccgccctggctcagctcccgcggccccgcccgtcccccctcccaggactggtctgttgtcttttcatctgttcaagaggagattga

SEQ ID NO: 15276 - DNA, 3248 bp, Homo sapiens
agagtgctccgcggccgtgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgccccccccccttttttttttttgttaaataaagtgctttttgttt

SEQ ID NO: 15277 - DNA, 1177 bp, Homo sapiens
gccttgttcccgcgttgagccgccgccgccgccgccgcctcctcagcttcagcctccgcgccaggcccggccccgccgcgccatgtcggactacagcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacccctcctcctcctcctttctccttccaacccccggccaccgtccatcctgccttagtgggtag

SEQ ID NO: 15278 - DNA, 1382 bp, Homo sapiens
cattatgctaacagcataaacatgcagggggtgggagcagggtcacaaaagtgagtgttgtcaattctacttggaatgaaaggttgaaataatttaaacagtacgggaaatgcagagcaattttctcctctggtgacaatatagtgtccaacacttggaagtgatttttaagaatgtttatttaaattaaaaggatggatttccaaggaaaaaaaataaggaaaaggaaagaaaaaactgaacagaaaacgcaaaagtatcagtttggtcactaacctttgcaaggatacctttttattttctttaagattcctgttgtttatacacagattttaagtttactcctactgctgacccaagtgaaattccttctccagtcacagtgtcaacctctaccccccaactgcaacgagagttttgaggggcatcaatcacaccgagaagtcacagcccctcaaccactgaggtgtgggggggtagggatctgcatttcttcatatcaaccccacactatagggcacctaaatgggtgggcggtgggggagaccgactcacttgagtttcttgaaggcttcctggcctccagccacgtaattgcccccgctctggatctggtctagcttccggattcggtggccagtccgcggggtgtagatgttcctgacggccccaaagggtgcctgaacgccgccggtcacctccttcaggaagacttcgaagctggacaccttcttctcatggatgacgacgcggcgccccgcgtagaaggggtccccgttgcggtacacaagcacgctcttcacgacgggctgagacaggtggctggacctggcgctgctgccgctcatcttccccgctggccgccgcctcagctcgctgcttcgcgtcgggaggcacctccgctgtcccagcggcctcaccgcacccagggcgcgggatcgcctcctgaaacgaacgagaaactgacgaatccacaggtgaaagagaagtaacggccgtgcgcctaggcgtccacccagaggagacactaggagcttgcaggactcggagtagacgctcaagtttttcaccgtggcgtgcacagccaatcaggacccgcagtgcgcgcaccacaccaggttcacctgctacgggcagaatcaaggtggacagcttctgagcaggagccggaaacgcgcggggccttcaaacaggcacgcctagtgagggcaggagagaggaggacgcacacacacacacacacacaaatatggtgaaacccaatttcttacatcatatctgtgctaccctttccaaacagcctaatttttcttttctctcttcttgcacctttacccctcaatctcctgcttgctcccaaattaaagcaattaagttcctgg

SEQ ID NO: 15279 - DNA, 1580 bp, Homo sapiens
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 15280 - DNA, 1857 bp, Homo sapiens
tgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 15281 - DNA, 1564 bp, Homo sapiens
ccggcagcaccatgtcgctcatggtcgtcagcatggcgtgtgttgggttgttcttggtccagagggccggtccacacatgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 15282 - DNA, 1871 bp, Homo sapiens
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 15283 - DNA, 1663 bp, Homo sapiens
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 15284 - DNA, 1864 bp, Homo sapiens
cagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 15285 - DNA, 1810 bp, Homo sapiens
ccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 15286 - DNA, 1877 bp, Homo sapiens
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 15287 - DNA, 1587 bp, Homo sapiens
cgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 15288 - DNA, 1442 bp, Homo sapiens
ccgcctgtctgcaccggcagcaccatgtcgctcatggtcgtcagcatggcgtgtgttgggttcttcttgctgcagggggcctggccacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttcc

SEQ ID NO: 15289 - DNA, 1632 bp, Homo sapiens
atgtcgctcatggtcatcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactatttgctgaaagaaaccgctgttatcattaccatgtccacataaccccatctgttatccactgggttc

SEQ ID NO: 15290 - DNA, 1740 bp, Homo sapiens
ccggcagcaccatgtcgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 15291 - DNA, 1741 bp, Homo sapiens
ccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 15292 - DNA, 1596 bp, Homo sapiens
atgtcgctcatggtcgtcagcatggcgtgtgttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 15293 - DNA, 1475 bp, Homo sapiens
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 15294 - DNA, 1529 bp, Homo sapiens
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 15295 - DNA, 1580 bp, Homo sapiens
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 15296 - DNA, 1694 bp, Homo sapiens
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctca

SEQ ID NO: 15297 - DNA, 1320 bp, Homo sapiens
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagtt

SEQ ID NO: 15298 - DNA, 1590 bp, Homo sapiens
ggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 15299 - DNA, 1587 bp, Homo sapiens
cgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 15300 - DNA, 1447 bp, Homo sapiens
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 15301 - DNA, 1396 bp, Homo sapiens
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 15302 - DNA, 1596 bp, Homo sapiens
atgtcgctcatggtcgtcagcatggcgtgtgttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 15303 - DNA, 715 bp, Homo sapiens
gaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtc

SEQ ID NO: 15304 - DNA, 1448 bp, Homo sapiens
gagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccacatttagtggcacaaagtgaacaattctgagaattgacaactgttatgaatcttacagaagttcatgtttatcatattcattctattaaatgaggaaacagagacatagagaaaaacgtgcatcgttttaaagaaacagtgatattctatggtgaaggagtgaaggatgtccccgaatatgccagattggtatatgattgttttgtgtttaaaacagtggagaaattgtagattcagaaagggagagctgacctgtctcttcccgcacgcggcaagccgtgaagattcctctgggagggctatccgagtcatacaagggcaagaaaatagctcttatcgccagagacctggaattggatgctgcaatgaacctgaataaagatacttaataaacacctatctttcacctattttacagccccccgcaaccaatatatctcctagtgactcctctagaaaatttattgcccctagccagcttttcttcatcctgtcatttcttttcaaatttatcattcttggtctaaaaagcataaaagcatcttgcttaggccacttctatggatttcactctcttgcgagttcctcatgtacatgcaaaacgaataaaatgtgtatacttttattttgttca

SEQ ID NO: 15305 - DNA, 1332 bp, Homo sapiens
gcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 15306 - DNA, 1407 bp, Homo sapiens
gggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaaaaa

SEQ ID NO: 15307 - DNA, 1559 bp, Homo sapiens
gcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaaaaa

SEQ ID NO: 15308 - DNA, 1598 bp, Homo sapiens
gcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatcc

SEQ ID NO: 15309 - DNA, 1209 bp, Homo sapiens
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccaaatacaagaacccagaaaacacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatcc

SEQ ID NO: 15310 - DNA, 1221 bp, Homo sapiens
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccagaaaaaaaaaa

SEQ ID NO: 15311 - DNA, 881 bp, Homo sapiens
atgataccaacacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatcc

SEQ ID NO: 15312 - DNA, 798 bp, Homo sapiens
atgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtttactgccacctccagaaaagctcactgccgaggtcctaggaatcatttgcattgtcctgatggccactgtgttaaaaacaatagttcttattcctttcctggagcagaacaattcttccccgaatgcaagaacccagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattgtgagcataagctttagaattaaagcgcttgagcttgcagtgcatcagataaaattttatatttgttcaaacagaaatgatattatgattgcataagccttaaaatgaattgtgttattt

SEQ ID NO: 15313 - DNA, 973 bp, Homo sapiens
atgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtttactgccacctccagaaaagctcactgccgaggtcctaggaatcatttgcattgtcctgatggccactgtgttaaaaacaatagttcttattcctttcctggagcagaacaattcttccccaaatacaagaacccagaaaacacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatg

SEQ ID NO: 15314 - DNA, 1028 bp, Homo sapiens
gcagttatcatagagcacagtccctcacatcacacagctgcagagatgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtttactgccacctccagaaaagctcactgccgaggtcctaggaatcatttgcattgtcctgatggccactgtgttaaaaacaatagttcttattcctttcctggagcagaacaattcttccccgaatgcaagaacccagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatgaacaatataa

SEQ ID NO: 15315 - DNA, 928 bp, Homo sapiens
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaa

SEQ ID NO: 15316 - DNA, 3258 bp, Homo sapiens
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 15317 - DNA, 3165 bp, Homo sapiens
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 15318 - DNA, 2088 bp, Homo sapiens
gttttgctcttgtcacccaggctggagtgcaatggtgcgatctcagctcatcaagttcaagagactctaatgcctcagcctcccaagtagcaggggttacagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaa

SEQ ID NO: 15319 - DNA, 3261 bp, Homo sapiens
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactgcaggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 15320 - DNA, 446 bp, Homo sapiens
tctgcactctcccagtatctatttccatcatttgaaacttttaatacaaagaactgcatagcgtataatccaaatggaaatgctttagatgaatcctgtgaagataaaaatcgttatatctacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataata

SEQ ID NO: 15321 - DNA, 749 bp, Homo sapiens
gccagcccagaaaggggctcccacagtgcagtgggggggctgaagggctcctcaaatgccaccaaagtgggagcccaggcaggggaggtgccgagagcaagcgagggctctgaggactgccagcatgctgtcacttctcagcaggctggattggatttggcacttctttactgaagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtgga

SEQ ID NO: 15322 - DNA, 1244 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 15323 - DNA, 1094 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtactatgccaatcagaatggctcaaataccaagggaagtgttgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 15324 - DNA, 838 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 15325 - DNA, 1335 bp, Homo sapiens
agatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaagaatgaaaa

SEQ ID NO: 15326 - DNA, 1206 bp, Homo sapiens
agtttagagattgggctgtttcctcactgatacatatcccttcacacttctataatttaactctctcaactgcatgtgaaagatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctattt

SEQ ID NO: 15327 - DNA, 1553 bp, Homo sapiens
tgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 15328 - DNA, 734 bp, Homo sapiens
ccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcct

SEQ ID NO: 15329 - DNA, 951 bp, Homo sapiens
cacaggggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactcc

SEQ ID NO: 15330 - DNA, 537 bp, Homo sapiens
atggatcgcccggggccaggctccgcgcgccccggccggaccgtgcacgtttggggttaccgggttgagtggaaagtacggaacggtaggaagctgcagcccagcgagtgggcggggcgaggagacctaggagggttcaaaaggaggtggaaggatacacgggccacagtcggaactactttccgaaggaggtcacgtgtgtccctagttggggaactttccaaattcccactccccagtgatagctccggaggcaagtcgtcttcttcctttgctcggggtgctcttgcctggtgcaggcagcggaaccccaacccttcctgcgccgcggcggaaacaggggctcggaccagcctcccgaaggagcgctgtcggggctggcgcttggggaactggttacacaagcacccacatccaaacacgtgcccccgcctccccgcctgctggctgccgccgattcttacagaacgcggggagagagtccccaaactggtgccactcctcgcctgctaccctaagagcaagccaaaggactga

SEQ ID NO: 15331 - DNA, 2724 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggagaaagggactctggagaccaaggacccaaccaacggttactacaaggtccgaggagtcagtccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagaggcaagtgtgtctta

SEQ ID NO: 15332 - DNA, 872 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggcgagggaggtgcccaggccagcctgggccgtagagcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggagaaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtga

SEQ ID NO: 15333 - DNA, 2279 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggagaaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtga

SEQ ID NO: 15334 - DNA, 2574 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggagaaagggactctggagaccaaggacccaaccaacggttactacaaggtccgaggagtcagtccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagaggcaagtgtgtctta

SEQ ID NO: 15335 - DNA, 2993 bp, Homo sapiens
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggagaaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgtttaataataaaaaaaagtcaaagaggcaagtgtgtctta

SEQ ID NO: 15336 - DNA, 1333 bp, Homo sapiens
tctcaacaggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggcccttt

SEQ ID NO: 15337 - DNA, 3808 bp, Homo sapiens
cttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtccggtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcttcctagacaataaaggcagttgatagctctg

SEQ ID NO: 15338 - DNA, 2474 bp, Homo sapiens
gcccgcctgaggaagccgtgtgcctgggatgccaagagccagagaatggatcttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaagtacgggagggagatccgggatctcagggagggggacagagaaaaaggccaggcttaggctgccccggagagcaagtaagcaggagtgcaatgaacaggggtcctaacagtgctgtgagctcctggggcagggagtgggtctgatgcatcggtgtatgtgagcctgggcaacatggcgcctggcagagtgggcgctaggctgaggttgacctggactagactgaacttcatctgcagggcagccagcattttggattgaacacatagctctttcagtcaggaactgtacagaaagatagggggaaaagcggtttgtggtttgatccttgctctacaagagctgttagtctagagagaccccatctctacaacaaaataaaaataaagagctgctagtctcaccagaaaagcaggtcactcacacagctgtgggggagtgggtggggaagcaataaaggaattgctttgagaaaactt

SEQ ID NO: 15339 - DNA, 3397 bp, Homo sapiens
tgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtccggtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaa

SEQ ID NO: 15340 - DNA, 2081 bp, Homo sapiens
ggctggctgagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttgttcagctaaactttgagaagaatttaattatgtctcatgaggtatcaaactatgtaattttgtccttgttatttttgtttcctttgtaatttacttgatgagtttatatcttcattaaagaatgttattataaagtgttttatctatgacaatttagaatcatgtaattggaggaaatccttcatacactctatattttcagtagtagagtagtaaagttgaactctaagtgtgactaaattttaaatgtcaaactataaatatagaagcagctttattgtggtaataattcatataccatacagttcactcatttaaaatatacatacaattcagtggtttttagtatttttgcagaattgtgcagccatcaccactgtctgattttaaaacactttcataccccaaaatgaaaccctttaatagtcaatcgctatttttcccctctgccctagccctagacagccactaatgtactttctgtctctatggatttgccctttctggacatttcttataaatggaatcatataatatgtgatcttttatgactggcttcttacacttagcatcatgttttcaaggtttatccatgcagtagcatgtaggcgtgcttcatttgtttttatggctgcttaatattccactgtatggatgtaccgtattttgtttgtccattcatcagctgataaacatttagattgtttctac

SEQ ID NO: 15341 - DNA, 1618 bp, Homo sapiens
agctgggatttgtcccgcccaccgccgccagcccggttccgtttccggctggctgagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactgtgtgagctaccacgccttgcctgagttgatcttctacaagagttcaaacaaaaaacagaccataccaggatgatcacttcaaacatgaggatgggtataagctgacgtcagacacagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctg

SEQ ID NO: 15342 - DNA, 1700 bp, Homo sapiens
tccgtttccggctggctgagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactgtaagtttgtttacacaaagacagaaatttcaaaatgctttaaaaatgtgccatagttttttttaattggattgttctttattttagaatttgagttttttgttagccttctatcctatttggaaatctgtaagcttattttctccagtgactctgccattgctaaagtattttattttctgattataaaagaaatgtgtactcatgcataaaaccccaaaaaacataatttaatataaataattataaaaattaatcatagtcccccagcccaacaataaaccccattaatattttggtctgttcctttccaatcttggtgttttatgaaagtgtgtgtaataggtacagttttatatccttttttcccctcatatcgaatataaaactcaatttggcatagtaaagttagtgggggaagtaaagtcattgtcaagagggagggaaccacagaggtcaaccactttttaaaatgtctccccttttttcataaaggatttaaggtagcagagatcaatacagtaatttaaagaactctgacttataaataaagttggttattgacttagaactgatatttcactcacaggtctgtgagtgaggtctgagatatcttcag

SEQ ID NO: 15343 - DNA, 2806 bp, Homo sapiens
ctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtag

SEQ ID NO: 15344 - DNA, 3071 bp, Homo sapiens
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgc

SEQ ID NO: 15345 - DNA, 2731 bp, Homo sapiens
ctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagctg

SEQ ID NO: 15346 - DNA, 2527 bp, Homo sapiens
agtggcaagcgctgcctgagcagttctagctgggagaggtgggtgctgcagagtctgggattccagggtgaaagccacaggttcccctgaataagctcttactgctggtggttcctgaactgaagatgcaggcggatctggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggtacgtggggcctgccaccctctcccttgcctggcctggtgcccttggggctgtggccttcactatggtgggtgatggagcggggcaagcgtggcccagggtttctggggcagcctggaaaggccagggttggatgttcacagcctcctgagaagctctcccagggtcctcagggctctggatcctggtgggtctggccaggccgaatctgaggggtttcagccatggttagaaatcccaggcctgtctgctgggctgggctggcctggcatggtttcctctctgttgagggctctgtgtaccctctgccagcttcccacattccagcccccagccctctccccgtcttctcctgtccccattgctggctgggttctgtgctcagaaggcacatgctgatgtgggcctgagccaagggtgattagggaaactctatggctctttagctgggagtgtgtacgtggctgtcccaggcaaagtgtgtaatcctggccttgccacgaggtccttgggaattattcacaggctttctaaatcttgcgtcggaaacagcttcaaatgcctgacttaatggtcccactaccacatagataaggcattaaaataagcctcatgaatggaatcaggcctggtttttaattatctgaggcccctgtcttatctccgtctgcctgaggcttaaggaaggcaccaaggtttatattctgcctggttttttcttcccagagaggatcgggcttaatttcctctctgccctcattgtatcaagtcctctgaacacggcacagtgtagaaagttgcactcaattcagaaaatcttgacctgccaggtctcccggcagatgctgaaaataaacacaacagaagtgtggctggtgttcttgttctcacatattacaggagactgagctcagagagggaaagggcttgggtaagggcacacagcagttggtggctgagccagaatttgaaccttgggccctgatggcgattggtttgtccccatgcttgccacccaagctgagatctttggggtaatttgtcagcccttctttgcttcctccttatgcctggattttaaagaattgtggaagagtcagcttttaagtggtagtgacctatttgtgtcatgcaggctgctgtctacctgtcctagatgccaagagagggagatcactaatttatgcacctactgtgtgccaggcgtgtgacacacatattgtggccacatcgttgtaagaggtagtgttgagctcgctttgtagctgaggcctctctgaccactggaggcgttggatgagtcatctggggccccacacctggcatggagcagagctgggctttgaactcaggtttcttgttcagagggtgctttttccagcaggccttagaggaggcccctgaagaagaagcattttctgggtttcttctctctcatttagtctcagcttgtggtgcctctgcatccccagcagagtcctagccccatcacagtccaggacaccggcctttcgtctgcccagtgctggctgcacttcacgggcacctgctgggatccgctgggtaccagtgatcccattagattgtgcatcacagcatcttcattgcatccccatggggcttggtgagagcagtctagtcagagtacaggtgggctatggaatgaaaccacctgggccctgcctgggcccagcactctgctcggccacttagaacctgtgggaccttggtgagttacttcacctcactctgcctcagtttcctcatctgtaaaatggcagtgataacgacacctctctcagggttgttgtgaaaaggaaatgagttaacgtaaagtccttagatcagagcctggcatgtattagatgttcttttcagtgtgaggcctatgaggtgatagaaagtgttgaagtcatttcctttgcaatctctggtctaaagaaaggtgagtgaacagctgggcatggtggcccaggcctgtaatcccagcatttgggaggctgaggcaggctgattgcttgagttcaggagttcaagccccccctgggcaacatggcaaaaccctgtttctacaaaaaatacaaaaattagccaagagtggttgtgtgtgcctgtaatcccagctactcaggaagctgaggtgggagcatggcttgaacctgggagataggggttgcagtgagccaagatcataccactgcactccagccttggtaacagagccagatgctgtctcacc

SEQ ID NO: 15347 - DNA, 6340 bp, Homo sapiens
gcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcactaacccaggggatgccacctctgctgctccagtcgtctctctcgaggctacttcttttgctttgttttaaaaactggccctctgccctctccacgtggcctgcatatgcccaagtaactgctctcagaggatcccactaactgagctccctccaaggcagtctgggcagcttctaactaccttcctggacatgactgattgctcccgtgttcttctgagggctggtcttgtttttgtttgggtggctctgtctcactgctaacaccttagtgagatgccttccaccctcctgagcacaccagcctcccactgggtgtgtgcctagtgcggggcgggcggaggttgggagggtgttggcttggcttttaacctgtggggattttgtccaacaaggagtggaatgatttcagagctgccctgaggctggcaccctggtcacaggaaccctctgcgctggctcctgtctcagtcccctctgtagagttagatcagaagacacagaaagttctgtggccatgaaagataccagcttggaagggttgtgtcttcagtggcaccctcagaaaaattgtcttaaagcaaagaggtacctggctccagacaatttttctgatgaaaacaaagtctctgccccgtccccaccctgccaccctggcaaagttacttcctttacagctgcccagtgtaccatagaccagaccccaggtcagcatttgtcaagagcatggctgctgagtcccctgtggcagtcaatgcactgtttaccaaatgcaggtttctgttctccctccccagcaagacctgctgaacccagatctctggaatggggccctaggaatttgcatttcaacctgcttcccaggtggccctgatgcaccccagtattagagtttattgctaaaaggaacatgccctgtcactcctggtatcctgggagtcatgtttctcttctctctcagttctacttggagcaagagctttcctgggctgcaaatgagaaaacaattcctaggaacccacagcagtactgagcatgctgggagcttgggacttggagatgaatgagccaccgttgctgctccaagtaggactacttggagtgtagctgaggccttggacgcagtatgaccaggggcagctctgccagggctgttggccaatcagtcattttcatttcttgttggaggccaggtcctctgctgaactcatttcctagctagtgttaccctaattctgatgaagatcaatggggctataattcttgtttttgttcctctttgcagcattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactggcactgacggccaggatggcggaaatggccatcccctctgaggaccttgtaggcggtgagggacccatgctgggccagaaggaagacaaacatggtaattgcagctgttcttggggtagggcggggagcccagaaggtctgatctggcctctgctttttggcccaagactccatcagggaaatctatctagggctctccccttgtcctttcaaagggatactgccccttcctcgtcttgcagaggaaaccctggctaggaactgagctagtttatggagtctggaattcctggagagcttgggttcaccttctcacccctgtaatccaggctgctcctgctggaaaagtagaaacagaatccaaaaaaggtctggactcacccggtggttcccagccagggtttctgctgcaaggtgaggaaacatccatggcttgtacagatgtgagtctttgatgaagcccccaggcaggcaccaaggtgatgggactcagggccttggcttttagatacatcccagtccctgactgacatctgaccatgagggctggatgggtgggaacaaggaggagtagatggcaaaagtacctgagcccacttcccagccacagggtgaccctggcactgtaaaaaccctttgtcagtcatgccagaaggttctagaactgcccacctcttccatttcagtcctgctgaaaccccttagcctatttccgactcctctgtccatgctctgagttcagctgggcagtgtgtgggctatcacccctttcatttagacctacctagctggcccccatctgcagagccttccttagcaccattaggccttctacttgtgtccatttgaagcaggaggggctggatttggaaaagtctttgaagtgagagcaccacgcttgtcttcgttagaaactcttaactgcagaaaaaagttccagatggcaagggagcccttaagtggagattaggttgcattagactccaaaaccagaaaggaaaaagggtgatgggagtggagacgtgattggattcaggcccagaacctgtgaccatgctctgagctcagacttggggagggaggggtgtggctcccaccccttccagttaagacctgcctagcagagccccagtctccagccccttccctagcaccagagtctggtcaaaatgccacagaaaatgagctgctctgccagcaagctgtggagctgcctcctctccaggcctggcatcccttggtcagcccctcctgggagggcacagccgtattacagtgccagtgtgcctggccatcagcatcttcacccttcccagtctgtgtggggaggctgtaaaccccgtggattcagctccgtgtggagtttctgtgctatggtgggactgctcattttgccccatcatccctttggcctcccacacacctgccccttcccagggatcacgtgtgtctccagcctttcacctttctattgcaatggtggcctttgtccaggcaagagcaggcctgatggatgtactggtgagccccacagttggatgtcagctcagccgtccaactgggaggaacagtaggctcagttcctccctgacccctgacaccaggccgcagtgggcatgcacaggcccacagaaagtcagtctgggttttgcttttctcgtgagcatcacagttaaagaagcgctcattgagcaactacagtgcacttggtcttctgcaagtgctgggcacctagagataggaacagtcatggtccctgctcttaaggaactgatgacctggtggggccctgttgtcttcaaggaacccagaagccactgggccccaaaggtggaactgaaggactgggggcagctggctctcagcctgccacctctgcactgcctgcctttaaagaaccccaccccaccccatgatggccccctctgttccccttgtatttcagtgactgtgaattgaggttaggaaggcacacctgcccttctgtgtgctctctccacacgaaggatgacagatactgtgaattcagccctcacggccaactgtgaaggggatggagaaggctgggagggctcggggagagctcttaggggctgcggaagtccccacgggggtctgagagtggagcccaagctttggccctccaggcatccccagtttccagcctcacctctgaagccctgctgcctttaaccaccagagccgcagccccctgggtttctgtctaactcgaagtcttgaatcctagctagtttggggttgtgagcagtgtgtagcaaagttgatctctccatgtcaccaaatcaaaacaccctctgtcatcctacggcatttcctcttgaggtcacagagaggaatggcaagccctggaaacctgtgttattctgtgttgatttggtgtggggggagggtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtg

SEQ ID NO: 15348 - DNA, 2631 bp, Homo sapiens
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagctg

SEQ ID NO: 15349 - DNA, 1938 bp, Homo sapiens
atgtataacaaaaaagcaaaaatggaaccaaatgcaagtgagtctgcgattccagcgaggaggcagcggcagcccagagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagag

SEQ ID NO: 15350 - DNA, 3815 bp, Homo sapiens
aggcaagatgtcggtgtggagcgaggcaggagcgattgcagcaaccgtcacccccggagcccggcggcggcagcagcagcagcagcagcagcgcggggaggagacagcagccagccgcagtagccgccgcagccgcgggagcaatgcagacagcaccttgagaacgcgctaaagcactccaaaccgtggaccatgccgtgtccctgcaactgggaggggggaaaaccagattttttttgacataaaagcaagccagccaaaaatatataattttgtccttcaaggagccggtgtgtaaagagtgagcgctattttccttctcctcctcctcctctccctcctcctcctctccctcctcctctctctcctccttctcctcttctttttcctcctcctcctcctccctaagtgtacagacagcatcacatcacctggtttgcttctgagaaacagcatctctccttttcagggaccagagactcagagagagaggagacattctaatggagtccgcttgatatcccaaaataaaataataaattttggctcttgtcccctcctcccactcccaccccctcaaccctgtgtgagatgttggatttcttcttcatgagacattgttgagaagtcgcagtggttggagaggcggagggtagactacctctactcccccccctcttttttctctctgggaggaggaggaggggaagggggttgcagagcaagcgatggatgaggaaaacatgacgaaaagcgaggagcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggt

SEQ ID NO: 15351 - DNA, 17008 bp, Homo sapiens
gcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggtgatgcgttattgatcagtgcggcccaggggacagcactaatgagagcactgcaggctgcacgtggtgcctttgggctatgggactaggacaggagaccccacgtgggggggctcacagacggggctatgtgtgtgtgtgtctgtgtgtttgacgttgttcactcttgtttccccttgacaagcaagagccagactgtcccaatgacggggcactcctcagttctgtctgtatgtggtaggttccagctgtaccatctgggaagctaagaggagggtacagagccgagtggcagcttagtcaaggctactgagccaagatcgagcagggaaggtcgggagtggctaagctcgttcctttggaaatatctgttttcagacaccccaacccgagcctgtcatggcgtgtggcacctttgcatagagctctgaagtacagtaggaaagttagaacgtcttttgagttctgggtctctctgggggacctattcccccatttctgctgttttctcctgttctctgagagtagcatcccttttcacctcactgcccgcacctccttgccatttggaaagccaagatgacttctgaggggctccttagagctcaccgtcattcagggcaccccctgaagtctggtccctgagaatcagggctctgggcagggagttctaggacattccttttcttccctcttctctgctactcacaccagtgaagcttattcccccaccaaggtggatgcgggttcttggggtacgtccatgttgggttatgtggctgtacctatgataacacgtttgcaaaagatttccctgcctgtcacccttgaggagtcctgttgggggagcacaaagggaggatgtttgttacacttctgcgttctttgctctagcctggtgcggggtcctcaagtagcttccccatcggaagcctgtgtccctcacctgtgtgtgttccctcagtgccccaccttccctccctcctcttgatcccaacctgggccggcgactcttcctgaccatgttggggaagcccctggtgttctgtatctgtaggaaggatgccgagagcaggctgggcatgcagatgggagaggagaacctctgggtcatttgcccatgttttcaaagccctgaccccctgcatgtgacctgatacaaaagggaaatctgtccccaagcagagcaatagcaggattatctgggcagtgaacaggaagcccagggcggccacagcccctctgtgtttcctgggtactacctgggccttagttttcttgtagctactatctatccaggcatctccctcctagagggccagagagaggaactggaacttcaaaaaccctacctgatcttactttcaaaatccaaatagacctatgaggatctcttccccaccttgggtgactcccagactggttcatgctctgggggccaaacctgcttccaaaccgggaagaatggtgagatcagtcatgcttcccaggagcctggctacaggaaacccctgtgtttcccaaagggccctcctgaattgcctttccaacactcccagcttactgggactagaggactaaagaccccggcttgggctgctcctaagcagacactgctcttctggggacatctatggctcttggcttgacgacgtgtgtgtgtcttggaggcattttatatatgtttgcctgagccccagccactctggggttgctggggatggctcttgtcaatggacacctccccatcccaacacaacactctgtgtcccagccctgggcctggacttgcacctgtcttggctctgcccagcagcctactgagtgcctgaaacccaaccactcacttctcttccatcacaccaggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgtttccagaattaactaaaatgtccaaccacagcctttggcaaggcctagcatgatctccaacagctgatttttccattcattcatgagcaccagtttgggattaaggacagggcctgagtgatccaggggaaaacccagccctttgtggaacagggtgccttgggtccatccctgaatctgagtcacttgctcttgacttctcgatctttccccacttcactactctgtccccacctgcattggtctctgctgcagccaggccaggatcctggccttcagtgccttcctgacgcccctaccctgtcccctctacaccgccctgacttgttgagaaaccagctttaatttgcacacatttaaatccaggaagaaccaaaccgctgctttccctgctggcttccatctttattcgctgatgaggttttgggaggaggttatattcatcttacgcagggaggaaaaaaaaagaggaaagaggctgtatatttttacatcataattaccagcctcacctgcaactcattctatacaatgacacgaccaagatttgtgtgtttgcccttgtcccatcacagctgcacacaggtgccctgtacacataagtcactgactcagcagcgagttgttccagtcagtcttgcttttagcaaaccgtcatatacatgggcttcccgaggggaccagtccacagggtgaagattcaccaggaagccttggctttgcagagagaaacatctcagctttctttaaagggcatgtggatttgcacataaatttcacccaactcttccaggatacagattattcataaaaccaaggagcttccttcttggccccctgtgggaggacgtgccccttgtgtccccatccccagagccaagctggaaacccaaagtcattgcttagatccattttgtcctggtattccttttactgatcaaagagaaaattttcatcttgccatggacccccccatcctcaccccatccacttgtctccacagctaccttggattgtcagtcaatagaagcccttgactgatattgaccactagacttttgtatccagggaacctagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttgcagctgtgtcagtccaatccctgccctcatcatctctctgtgtgtccctatcttcatatggccatcttcttataaggacacgagtcacattggattaagggcccaccctatttcagtatgacctcatcttaactaattatatctgcaaagaccctctctccaaatgaagtctcattctgaggtactaggaatgaggacttcaacatgtctttttttttttttttttttttttgttggggacaccacaacttataacaccctctaagacattttctcttgtgccttgactggtcctccactgtagaacccaggtgcccttgaagatagattccccagaattcctggtctacaaggtcaggctgttgctgtcatgcttaccaagcttgccccaatcaacacgtcccatcactgaattccaacagctctggatctcagttctgtggctgtatgggaacagcctgtgtgtaagtggcttgtctgtagcggactgtcacttgacccctgaatgtgcctcatgaccctatccaaagcagttggtgacacagcatctgattttatctatactcttgttcattgacaaaggagtggattttgatgagctacattttgctgtttccttttttggctttgcctgtgatgtggggaagttcctaggcagactcatgtggccactctccctggctcccagcctcacctcctcccgtaccacctcaccctcacctgcacacacctgcaagggaatcactttgaactccaaggggagtgacaggcagcaaatgtcagtctgggtcctggaatgtggagccgcagtgaacctctgtcctctctggtcagtgcctgactatgatattaacccaaatcccagactcccttctcgaggccctgcaatccatacccattctgttaccagtttagttttgaaaccagtagtggggcaggaggttgatggaaaatctgcggtcccagtgacctcctggacttgtcttagtagtgcctggcacatagtaagtgctcaagaaatgtttacagaatgcagacagagaggtttgctgggtaagagtaagaccctggcacagggagttagaagggcaccattggcagggctggatggtattgggattcccctttgccagaccatgttgtgggtgccatatcaaccccaatgagtttgtttgttaggtttgttgttgtggtttagagttagagtcttgctctgtcacccaggctggagtacagcgtgatcatagctcactgcagcctcgaactcctggccacaagcaatcctcccaccttagcctctcaagttgctggtactacaggtgcacaccatcatgcctggctaattttttatttgttgtacagacagggtcttgctatgttgcccgcgctggtcttgaactcctggtctcaagcaatccccctgcttcagcctcccaaagcactgggattacagggctaagccattgtgctgagccagtttgccaggtttaatatctgtgacgtatgaagcgacccattgagtcaggtggcccaggatgtctaggaggcagagtaacaatccaccctgaacagccctcattcacagagcacttactacgtgccaggctggaattcctatgatggtttggggagatcagtagtcttattctcgttccaatggggcaactgtggtacagggacagaaaccagcctccaaattgcagacccagcattttaaaaacgagtctttgggctcatccattcccaggaacccacctccaggtcaaggggttcatgtccagctgctcatggggatgttacaatcccagcctctgagacttattggcaacttggaaccaggaaagagagagaggaaaagcaggaagttgtggaagggagggtgcaggggctggcagggaccatactgggagtttgcacggaagcttgaacttatgttctcaaactgacaggctgccagcagcagcccggatttccaggaaatgtacatctgggttggcagagtccctcctgggtccctccagtatccctgctccaggcttcctatcccctccgtctctcctgctggatgttgcactgtggtcccgtgttcctgagaggcgtacatcagtgagtgctcttccctctcaggggtgggaaagggcccttccttcccactcattgggatcatgcagctcccatttcctaacaccaagaatatgaaggattcatctcatggggttgagaatggctgtcctccttccactgaggactgagctggaggagatggactctgtctagaatgtgcctgatctaaataagaccttgtttcccaagcatgtcccatagacctttcattccatggaaaactcgccggatttgcattattgaaagggtcctgggacaagcatgcattggaaatgcttaggtaaaatgaaactaatttcttgattgcaggacttatcagaacttttaagacactattgtgtggttgaatctctaaatgcctgataggaggctgttcttcccaagctttcccaggcttgtttctgaatctccaacaaggtcaacctctgtgaatgagacttgataccttacctggtactgaaggaggcaatgtcaatgtactggcccacagaaaagagctgaccactagcattcatagacactgctaggagatgagaaaggtagcttagagcccgattccatccatgtggacagtggttccatgaacaagaacaccacatctggctgatggtgtcttccaatggaggggtcaaatctgctgtgtgttggtggcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttggaaaatgcagaaagaaagattctgtctctaagactctgtgtatgatcctactcggtaatctgcctgcttggagaaaaatcatttatcttctgggacggcttcaccacaaggcctgaatgctatgcccagtctagtaacagctgggctggaagtcacggcatatgggggccttaaggaataacagtgtgcgtggtggtgtgcaggagagctgcaagggcttttctttcttgaggaggtttgtaaaatttctgctgttcagtctgggcttctgggaagtcagggggtgctgcatataaagggcaggaaaaggagcctgactccaattgctctttggtttcttccctgaatggaaggctcaaaatcaagtttccacccagataagatcttgaggtcctagtggaccaccagctctactcctgagctcttgaaatacctctaatcaccagctcggtggctgagagtaccttcttgtccactgcctcttcttttccttctcgtcttcacttatcccccatccaacttctgcccgataatatctcccctgtattgtaaactgaggagaaagttgcacaattgtagagatgaaaaatagctgccatgtatttagcttaaattagctcagaagaaaggctccctccctccattgagcgggcagcacttgtttatgccaacatgctatttgcatcgcgccttcttaaatttgaaagtctaatgattaaaaacaaatcttagtttttcttttccaccacttaaaaaaaaaaaaccagcttggctagttcttctagtttaaaaataccctgacctccagcactacagtgagaattttggaaaggctggtaccaggatatcaggaggaaataaatacaggccaacaataaccagaggccttttctgagtggtgggcgacaggatgaacaaggtagaagagaggtctttgtgtcctcacacagatgctggcattctgggtttgtctggaattcagtgaacctctgtcctctctgacagagatttcttcaccaaccattcattcagtgggtgatttgttgagcatctactatgtgttagaccctgggcattcagtgatgagtgatacaatgtctcacctgttctgaagcctaaagcccaatggggaagagagacaagaagcaagtcaaccacaaatatataaatttgcaactcatgtagatctatggaaagaaaactcacgggggaccagaaacatgggagagggtatactgtgggagagctgctgacaaaggtctttctgaggaggtgacatttaagtcaagatctaaaggaagagaaggataaagagatgttcattctaagccagggtttctcaacctcagtactgttgagctatttggggccagataattctttgaggtggcgactgtcctgggcattggaggatgttaagcagcttcctcaactctccccacaagataccagtagcacctggtactggtgacatccaaaaacatccccagacacaccctgactttgctgtctggaatcaatcctcataaagccccaagccttggagcacagaggctggaagcccatatggtggcatgtcaggcatggtgtcacctgagcttctctgacccccacttctgatatggcatccagtttggagtctctgttctccatgagctcccatagctgtcccatattccacaaggcattgcttctgggccacggtcctctagttccagcatagccctatttttgggtatgttggtggatttcaaaagcctccagttgacatccaaagtgtgacatccaaaaccatctccagacattgccagatgtcccctgagttgtctccaggccacgcgactaggattcaaatccagcatcctgccatctgcaaccttccatgggagaaaggaaatcagaggagaacaggaaaacacaaggaggggactccttaagtgaacattgcagggaaataggtttttaaagcactagttagcatcaccagtggtttgaaggctgtctaggtaaggagaatgtggacttgcctttcaccgtctgcacggacaggggctgaaatctccagtcattctctccatccttccacagcccttctaagaagcagatcctcttgctgagctgaaatcttgagacttgcatccggcaatcttggtgttgctttctgaggctactcagggaaagcccttctgtattccccaggaaggaaagtctcccagatagtgaagggccttttctaccttccttgcaattcccagttcactgtgaagaagagagtcaggccgggttagaatggctgtctctggtagcaatgaagcaacaacatagacagtctggacaagatgtggcagttctgtccagtcccgtgtgactgatttgggcatggagacaggcagtgggtgaggatggcctctgtaggtccagctgttttacccctagaatcaaatccctggagcttccggcagtcccaggattgggaagggtaacagagaggacgagtcgggcactgcaaaagaccagatcttggaaaattgctttgggaattgggacaccttccaagaagacagttgagttggctggggctctgccctagatggggtcaacctctccccaacacagccctgcccaggttggggcattggcagcttaagtgcgtcctggacaacaaatgtaatgtattggtcctgtaagattctagccattttcctctgcttatttttctacatgtgttacaagtaataatgtttagatgggtacatatgaacttgtgtaagttcaagtaactgctatgtagctacagcatgggcatcaaggtactctaaggtacttgccctgccacaccgaggccccctgccccggccccctttccctcctagccagccttctagggagcactgcacaccctgccccttcaaagctatctggacagtcctggctcgactggagcattaagggaggggctgtccttggtcaggcttctgcccaactgtgtgatgcataaatctttgcctggctccttcttccttcttttcggaagtctatctcctcctgagggcctctgcggtcctaacctatcaaggaatatcatagattgtactccccaccccatcaaaacacaccctgactttgcgtctggaatcaatcctcataaagccccaaggcttggagcacagaggccagaagcccatatggtggcatgtcaggcatgctgtcacatgagcttctctgactccacttccaagatggcatccaatttggagtctctgttctccatgagctcccatagctgtcccatattccacaaggcactgcttctgggccccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgattctggaaaaaatggagaaaagtgggtgctgccttcagggtactaggagtccgatgaagagagggaggagttccagtagggtcccgaggccccacaggagctcccaacccagagaaagaccctccaggaaggattctcagaggaggagacttctgaaccctgtcttgaaatttgagtagaatggtagggaacggtgtgtcagacagaaggaacagcctatgtgtggactcagaggcaagatcatgatttattgagggtaactgcaagtggctaaaatcctgccccctggcacttgcctgcctttccctgctttccccaaagcctgattttgggaccctggagtctccatctccaaacagagggtgccctggctcagatgtggagaccttgacttctttccccagcatgctctggttcctactgttagccttggtgtcctgtgggggaagatgtctgaggagagttttgtgcttgctggagtcagaccagtactcaggccacctcaggcctgctctgcatccctctctggctctacagacctctctctctctctctctctctctctctctctctctctgtctgtctgtctctgtgtctgtctctgtctctgcctgcctccacacagtgaaggatgtgtctctatttcttagtgccctgcattgggtcctgaagtccatgggcatcttggctatagatgggttggccatgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtaggtgcttcatcaatgtggcttttcttctcaatcacccaaatgaacctcccccagaatcccacctctagggggacattcctgaaaaataagggactagaatagcgaggtggtgggtgttacccatttatttagatatttgtgtcctggtgaacatggggagggatgcccaagtgtcataaggacaccccctccccccgtctacaaggcagaggtctcttaggatgtgagagagtctctggcaagaccagcccccaccccaccaaggccctcatagaaacagaacattcttcctccctatcccaaagcagaagttgactggggcagataaggcaagtcacattacatctgtgcccttgaccatacctggaccaggcagagaagatcccagacttaggtggtcaacgtttccaccccaagcctctcatttctcgctctctttgagacttgatcttgtaccaggatccactcgacagacttaacgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaattactgcattgcactactgccaagacaggtctgaattctattgtt

SEQ ID NO: 15352 - DNA, 1382 bp, Homo sapiens
agagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccaggccagtttgattgtcctaaatataacgtacaggagttggggggcctgagcacatgaagattccgtccccatcatcgagtggaagcggcttccttttatgttcaaaaagctgaatcgctttccctttataaagcacagctgaaaaggt

SEQ ID NO: 15353 - DNA, 4134 bp, Homo sapiens
tcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgc

SEQ ID NO: 15354 - DNA, 4252 bp, Homo sapiens
gaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtga

SEQ ID NO: 15355 - DNA, 4516 bp, Homo sapiens
gtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 15356 - DNA, 4618 bp, Homo sapiens
cgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 15357 - DNA, 4579 bp, Homo sapiens
gaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttg

SEQ ID NO: 15358 - DNA, 4682 bp, Homo sapiens
ggttctttttttttttttgtccccaccttcttccctatttaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttg

SEQ ID NO: 15359 - DNA, 4449 bp, Homo sapiens
gccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 15360 - DNA, 4793 bp, Homo sapiens
cgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 15361 - DNA, 595 bp, Homo sapiens
gcggcggcggcggcggcggcggcggcgcctcggagcgggcggcccgggctgtagtgccggcgccgccgcgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacagttcttttaagatagggcaggaatgaaaactctcaatatagagcaggattttaaacctggggcccgtgcatattcttcagggaatccagaaacctggagattatatgtaaaacttagttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatcc

SEQ ID NO: 15362 - DNA, 291 bp, Homo sapiens
agggactctgcctctaaggatgatgtctgccttggcctgccatgcctggaattccaattcatctttactggttctaaaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaa

SEQ ID NO: 15363 - DNA, 4858 bp, Homo sapiens
agactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacatt

SEQ ID NO: 15364 - DNA, 5941 bp, Homo sapiens
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaca

SEQ ID NO: 15365 - DNA, 6924 bp, Homo sapiens
atgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcagattttaaaacactaatcatttgtctttaataaccctgcctttagtttcaaatctaacttaccatatttcta

SEQ ID NO: 15366 - DNA, 5831 bp, Homo sapiens
cggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaggccaagtcaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatc

SEQ ID NO: 15367 - DNA, 5747 bp, Homo sapiens
ccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 15368 - DNA, 5707 bp, Homo sapiens
cgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 15369 - DNA, 1327 bp, Homo sapiens
cgggatggcccgcgcgcctcggcgctgcctctcggagctcacggcggagcggcggcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggctggtcacagtggctcacatctctaattccagcactttgggaggccaaggcaagaggatcacttgagccgaggatttcaagaccagcctttgcaacatggcaaaaccccatctctacaaaaaatttgtttaaaattagctggacgtggtggcgcatacctgtggtcccagctactcaggagactgaggcaggaggctccagtgagctgtttgagccactgcacgccagcctgggtgacagagccagaccctgtcttcaaaaaaataaaaaattaaagtggcgtgaggtgaattgcatcagaccccacatatgaataaatggatggttggcaaagtgttatatataataagtacaattccttaggtgtccttaggtgtactactaaagtgggtttgtgatagcccatatatttagtcatttatgttcaatagtgttatattcatttgagaaattattttaagaaatttaaaattaagaaagttttaaaagtcctttagtaattagagatttctctgggtgggtggatacggttgtttctaattatcccacacatttaatcatttatgttcaatagtgttgtattttttgagaaattattttaagaaatgcaaaattaagaaagatttaaaagtcctttagtaattagagatttttctagttgggtggataagggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttctgaaa

SEQ ID NO: 15370 - DNA, 1175 bp, Homo sapiens
agtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgcct

SEQ ID NO: 15371 - DNA, 8745 bp, Homo sapiens
ggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatcacagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtctcctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctcaggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgc

SEQ ID NO: 15372 - DNA, 7274 bp, Homo sapiens
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggaaacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaa

SEQ ID NO: 15373 - DNA, 8832 bp, Homo sapiens
cacagcgcagagcagccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 15374 - DNA, 9140 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggtgagtggcccggcccggaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaattgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccgcgtttcattgggaaatgacactaggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaac

SEQ ID NO: 15375 - DNA, 585 bp, Homo sapiens
acgtccccgggaatagggactttcccccagagactggaggaccccttccccaagcgtcagccctttccaaggggtgcctgcattgctggaattaaaggcctgccagggcaagcggattggatcttgcggctgcggagaggaggcggtgcggagaggcccctgcctcgcagggctggcactggcctcaccctggggacgcacagcgcgacaccgtgctcggctctgcgggacaccaggtcgcactcaggctggcggggcctttgccagggaagccatgccagcaccctcgtggtgtgagaaggcagcagaggcttcctcaggcttgcgaagctgggttccactggtcccgctgggctcctgctttctagaattatctgcgctgcctcctctccttgtggattccaccccatgtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgtta

SEQ ID NO: 15376 - DNA, 9162 bp, Homo sapiens
ggacgccgcgcgcagccaaccagcgcctcgggaggggcgcggggcggtccgggccgggggcgcgcagcccgtcacgcggcggcgccgtcacagcgcagagcagccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaattgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacag

SEQ ID NO: 15377 - DNA, 6816 bp, Homo sapiens
cccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcag

SEQ ID NO: 15378 - DNA, 5724 bp, Homo sapiens
ctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggatactagtaagaaaaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaa

SEQ ID NO: 15379 - DNA, 8746 bp, Homo sapiens
gaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgca

SEQ ID NO: 15380 - DNA, 5885 bp, Homo sapiens
ggattcttttcacacagtagtgttggctttgttctgttgggagggaaactattcctctaaaaaatgttcacatttttcctattacttcattcagtagtgaaatgtaatgatttgactctgccatgagtcagtggcatatctgagggatctttgaagttaaaggaaattggccaggcgcagtgactcacgcttataatcccagcactttgggagaccgaggcaggtgaatctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtcttt

SEQ ID NO: 15381 - DNA, 10669 bp, Homo sapiens
ggaggctgcttgagcaagctagtcattgttcatgcaacacaaaacattcccgcccctaacgccagaatggagcttccagatccctttttttttttttccttgattgctaaatgagcttccaaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaa

SEQ ID NO: 15382 - DNA, 7565 bp, Homo sapiens
cccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaaaaaaaaaaaaaaaaaaggtaatatttattatattattcaggtttcaactctgtagcaaaaatgggctctcatttccctaacttgagataacatagggtaggtccatatattttcattcttacagtggtcttttcatgggagtgaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcatttctgagcaaatgcttatcctagagaataactctgtatgaataaaattgcttaattgagtctcttactaaataagtaactagtgccatgcttttgtgagctcttggtatggcccatattactttgttttttgtttttgttattgttgttttgtgatagtcttgctctgtcgcccaggctgcagtgcagtggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaa

SEQ ID NO: 15383 - DNA, 3201 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaaggga

SEQ ID NO: 15384 - DNA, 810 bp, Homo sapiens
tggagcccgggttaccagctcttgcccgcgcggaataggctttaagaaatcggagctgcagccatctgtttttctcttaatgctgcatctctgttctcacggtggtccttgggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgt

SEQ ID NO: 15385 - DNA, 2935 bp, Homo sapiens
gagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacatttt

SEQ ID NO: 15386 - DNA, 631 bp, Homo sapiens
gaaatgtcgtttttccccttaagacaaagcaagcaccctaaaccagttaccctgtgcactcctgttaagattgttgctaaggaaggacaggagttggctgctgaagcctcaagatttcctttaggctcttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatg

SEQ ID NO: 15387 - DNA, 6499 bp, Homo sapiens
gaggagcccggagcgccctggcgggcgtggagtccccagcctggccgctgggaggccgcgtccccaccggagggggcagggcgcactcacccggccgccctgaggccgctggcggcctgttggcttctccacaggcgcgctcgccgttcaagcgcgctttgtccccgccccagatcctggggggtgagcggtggagaaggggcgggcgcccgcgagccgtgaatcacctcctcctcttgctgcctcagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaaggctacagaaacttgaggaaagcaatcgagaagaaagaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagattttaaacatttttttgtagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcagtctgatgaaagtgactcctctctctcggaggtacacaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 15388 - DNA, 5044 bp, Homo sapiens
gctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaaggctacagaaacttgaggaaagcaatcgagaagaaagaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaaca

SEQ ID NO: 15389 - DNA, 6601 bp, Homo sapiens
gaggagcccggagcgccctggcgggcgtggagtccccagcctggccgctgggaggccgcgtccccaccggagggggcagggcgcactcacccggccgccctgaggccgctggcggcctgttggcttctccacaggcgcgctcgccgttcaagcgcgctttgtccccgccccagatcctggggggtgagcggtggagaaggggcgggcgcccgcgagccgtgaatcacctcctcctcttgctgcctcagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 15390 - DNA, 6643 bp, Homo sapiens
gaggagcccggagcgccctggcgggcgtggagtccccagcctggccgctgggaggccgcgtccccaccggagggggcagggcgcactcacccggccgccctgaggccgctggcggcctgttggcttctccacaggcgcgctcgccgttcaagcgcgctttgtccccgccccagatcctggggggtgagcggtggagaaggggcgggcgcccgcgagccgtgaatcacctcctcctcttgctgcctcagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaaggctacagaaacttgaggaaagcaatcgagaagaaagaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagattttaaacatttttttgtagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagaaattctaaccttaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 15391 - DNA, 4866 bp, Homo sapiens
atgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatgttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaa

SEQ ID NO: 15392 - DNA, 5040 bp, Homo sapiens
agcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtga

SEQ ID NO: 15393 - DNA, 6400 bp, Homo sapiens
gaggagcccggagcgccctggcgggcgtggagtccccagcctggccgctgggaggccgcgtccccaccggagggggcagggcgcactcacccggccgccctgaggccgctggcggcctgttggcttctccacaggcgcgctcgccgttcaagcgcgctttgtccccgccccagatcctggggggtgagcggtggagaaggggcgggcgcccgcgagccgtgaatcacctcctcctcttgctgcctcagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 15394 - DNA, 9895 bp, Homo sapiens
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaagaaaacccatgacaaagctcccctgggggcctctgagtgcacaggcctctccatctgcccagcaccccaccacctgcagtccacctccccgtaagccatgcttgcctcccagccccaaccacatttggggagtttggggaatccagttcatcctctacttttgggggcagccagccaagcccactgcaagagctgaccggcacccctccactttgtcctccaccccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcatgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgacc

SEQ ID NO: 15395 - DNA, 5389 bp, Homo sapiens
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 15396 - DNA, 5519 bp, Homo sapiens
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaa

SEQ ID NO: 15397 - DNA, 5428 bp, Homo sapiens
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 15398 - DNA, 5004 bp, Homo sapiens
atggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccacctgccctgaccctccccaactctccctgtctcctctttcattcttcccctctttccttttccctctctttccccacttcgatctgagctgcttcttaacg

SEQ ID NO: 15399 - DNA, 2113 bp, Homo sapiens
ggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 15400 - DNA, 1709 bp, Homo sapiens
gtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagggtgctaatattaccactgggtactga

SEQ ID NO: 15401 - DNA, 2495 bp, Homo sapiens
gagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggt

SEQ ID NO: 15402 - DNA, 2505 bp, Homo sapiens
gggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggt

SEQ ID NO: 15403 - DNA, 3610 bp, Homo sapiens
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcact

SEQ ID NO: 15404 - DNA, 2181 bp, Homo sapiens
ttgaacttttctttttttagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtggaacagttgcagcacacccatgaggaacacagattttgtacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaa

SEQ ID NO: 15405 - DNA, 2296 bp, Homo sapiens
aaacgatcctcctgcctcagcccccctagtagctgggattagaggcacacgccaccatgcccggctaatttgtatttttagtagagacggggtttcaccatgttggccaggctggtcttgagttcctgatctcagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtggaacagttgcagcacacccatgaggaacacagattttgtacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaa

SEQ ID NO: 15406 - DNA, 3409 bp, Homo sapiens
ttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaata

SEQ ID NO: 15407 - DNA, 3493 bp, Homo sapiens
caggagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaata

SEQ ID NO: 15408 - DNA, 5824 bp, Homo sapiens
gacgggactgttaggttgcgggctttggggctcactcccgacggcattgtcttctcctcttctcagacagggcagaccgaggagtttggaccgagagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 15409 - DNA, 6226 bp, Homo sapiens
gacgggactgttaggttgcgggctttggggctcactcccgacggcattgtcttctcctcttctcagacagggcagaccgaggagtttggaccgagagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagatagtgggactgcaagagcttcaggtggacagtgtggagctcctcttagaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 15410 - DNA, 6295 bp, Homo sapiens
cccctgttcattattcatgggaaacagttgtgcagcatgccttgacattaagttgagcatctaaaattagtcctgctacaatcagttgttgggaacaaggtttcaatagttgtggcatgtgttaagtagacattgcaaggttggaaggaactccctagaaataaagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagatagtgggactgcaagagcttcaggtggacagtgtggagctcctcttagaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 15411 - DNA, 3597 bp, Homo sapiens
gacgggactgttaggttgcgggctttggggctcactcccgacggcattgtcttctcctcttctcagacagggcagaccgaggagtttggaccgagagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagatagtgggactgcaagagcttcaggtggacagtgtggagctcctcttagaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgggcccaggagagaaaacatcctacaaggcttggttggcaggagtttggtttgtccacagaccccatcaagttgccctgcaacagtga

SEQ ID NO: 15412 - DNA, 1326 bp, Homo sapiens
ggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 15413 - DNA, 1510 bp, Homo sapiens
ttgtttacaaaaacaggcggcaggctggggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 15414 - DNA, 1613 bp, Homo sapiens
gggtctttcgaagtggagacaggtgctgcagatctcacggccgcgtctcaggagctggtgcccggtgcacgttcagtgggggatgctccgcagtgcaggctcgcgcccgggttgacacgcagacctcttgatcattgcaggagctgaaacgaaatatcagagttcactgtcggattcgtcctttgttgccttttgatagtgaatccgacgatccagttttgcagagcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgctta

SEQ ID NO: 15415 - DNA, 5649 bp, Homo sapiens
atggtcggccgcggcgtccctctgtgcgctgcgcagcccgcggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggccgaagtctgctcggggaccgtggccgacgtgctccagtcggtggtcagtggggctgatggctgcattttttcctttggccacatgagcctgggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaatgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcgggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctga

SEQ ID NO: 15416 - DNA, 5808 bp, Homo sapiens
tcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 15417 - DNA, 7287 bp, Homo sapiens
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 15418 - DNA, 5695 bp, Homo sapiens
gattggaaaacgaaagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 15419 - DNA, 2955 bp, Homo sapiens
ggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 15420 - DNA, 2711 bp, Homo sapiens
aagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtgg

SEQ ID NO: 15421 - DNA, 2095 bp, Homo sapiens
aaggcatgggcaggaagccgtaactggggaagtttctgggcccagaagaaaatattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttg

SEQ ID NO: 15422 - DNA, 2879 bp, Homo sapiens
gcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 15423 - DNA, 320 bp, Homo sapiens
tgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacaggcaaggttgccattccatccccttggagcctcaagcctcgaagcctgggcggtgccacattcctctgttatccaaggaagaggaggaactgtcttcccagatgtccagctttaacgaagccatgactcagatcagg

SEQ ID NO: 15424 - DNA, 1124 bp, Homo sapiens
acgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcct

SEQ ID NO: 15425 - DNA, 908 bp, Homo sapiens
tcaggcccgcctgtttcccggtctcgctatcaagatccaacgcagtaatggtgaggagcggggtccctaggtcaaggggactcgtgagcggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttg

SEQ ID NO: 15426 - DNA, 6103 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 15427 - DNA, 1756 bp, Homo sapiens
taggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattgaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcacct

SEQ ID NO: 15428 - DNA, 5338 bp, Homo sapiens
gtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctcctgcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccaggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtcataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccgaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagttgacaataaaggaatgagtatcgtca

SEQ ID NO: 15429 - DNA, 3180 bp, Homo sapiens
ggcggtggctgcgctgcacccgactggtgggcgcaggacctgggtcggcaccggagcctgtcatcccggagcggtcggcgggggtgcagagacggcgatgcgcccctgtcccccgcacccgggccgctccgggctcgcgcctcccgccccgcggccccgccccctgccccaccccagtcgggaggcttagctggggccgcagcgcggcggcaacatcactctcgctgccgctgctccgccccatccccttctgtttttctctctcattctccagtggcggcggcggggaaggcggaggcagaggcagcagcagccgcgctggctgcaatgaatgatcccccagcttggggggaggactccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccaggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccc

SEQ ID NO: 15430 - DNA, 2544 bp, Homo sapiens
attctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctcctgcatggggcgggctccgggcacggctgctcggcaggcgctgctcccgcggcgactgggggattctgcctaattcacctcccatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccaggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctg

SEQ ID NO: 15431 - DNA, 3527 bp, Homo sapiens
gggcagtccgcactgcaattggttggcgtctccgggacggatttgaaacttggcggttaaagctccggctgggacagggcggcgggaggcccagggagaacggggaagggacatttagtttgagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaaggggtgctgttgctcacgcctgtaatctcagcactttgggaggctgaggcaagaggattgcttgaggccaggagttcaagaccagcctgggcaacatggcgagaccctgtctctacaaaaccaaaaaattag

SEQ ID NO: 15432 - DNA, 4348 bp, Homo sapiens
gctccggctgggacagggcggcgggaggcccagggagaacggggaagggacatttagtttgagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgttt

SEQ ID NO: 15433 - DNA, 2605 bp, Homo sapiens
ccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacgggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctac

SEQ ID NO: 15434 - DNA, 4378 bp, Homo sapiens
ggatttgaaacttggcggttaaagctccggctgggacagggcggcgggagaccccgggtgaacggggaagggacatttagtttgagacggtgctgagataggatcatgaaggaagaggtgaagggaattcctgtaagagtggcactgcgttgtcgccctctggtccccaaagagattagcgagggctgccagatgtgcctttccttcgtgcccggggagactcaggtggtggttggtactgataaatccttcacctacgattttgtgtttgacccctgtactgagcaggaagaagtcttcaataaagcagtagcgccgctcataaaaggcatatttaaaggatataatgcaacggtcctggcctatgggcagactggctctggaaaaacctattcaatgggaggtgcatacactgcggagcaggagaatgaaccaacagttggcattattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgggaggatcctaaggaaggcataaagattgtgggactcactgagaagactgttttagttgccttggatactgtttcctgtttggagcagggcaacaactctaggactgtggcctccacagctatgaactcccagtcgtcccgatctcatgccatctttacaatctccatagagcaaagaaagaaaagtgacaagaattgcagctttcgctccaagctgcatcttgtagatctcgctggatcagaaagacagaagaaaaccaaggctgaaggggatcgtctaaaagagggtattaatattaaccgaggcctcctatgcttgggaaatgtaatcagtgctcttggagatgacaaaaagggtagctttgtgccctacagagattccaagttaactcgactgctgcaagattctctaggaggtaacagccacactcttatgatagcctgtgtgagtcctgctgactccaatctagaggaaacattaagtacccttcgctatgctgacagagcaagaaaaatcaagaacaaacctattgttaatattgatccccacacagctgaacttaatcatctaaagcaacaggtacaacagctacaagtcttgttgctacaagcccatggaggtaccctgcctggatctataaatgcagaaccatcagagaatctacaatccctgatggagaagaatcagtccctggtagaggagaatgaaaaattaagtcgttgtctgagcaaggcagctggtcagacagcccagatgttggagaggatcattttgacagagcaagtgaatgaaaaactgaacgccaagctagaagagctcaggcagcatgtggcctgcaagctggatcttcaaaagctagtggagactttggaagaccaggaattgaaagaaaatgtagagataatttgtaacctgcagcaactgattacccagttatcagatgaaactgttgcttgcacggctgcagccattgatactgcggtagaagaagaagctcaagtggaaaccagtccagagacaagcaggtcttctgacgcttttaccactcagcatgctctccatcaagctcagatgtctaaggaggtggttgagttgaataacgcccttgcactgaaagaggccctagttaggaagatgactcagaacgacaaccaactacagcccattcagtttcaataccaggataacataaaaaatctagaattagaagtcatcaatctgcaaaaggaaaaggaagaattggttcgtgaacttcagacagcaaagaagaatgtcaaccaagccaagctgagtgagcaccgccacaaacttctccaggagctggagggtcaaatagctgatctgaagaagaaactgaatgagcagtccaaacttctgaaactaaaggaatccacagagcgtactgtctccaagctgaaccaagagatatggatgatgaaaaaccagcgggtacagttaatgcgtcaaatgaaagaggatgctgagaagtttagacaatggaagcagaaaaaagacaaagaagtaatacagttgaaagaacgagaccgtaagaggcaatatgagctgctcaaacttgaaagaaacttccagaaacaatccagtgtgctcagacgtaaaacggaagaggcagcagctgccaacaagcgactcaaggatgctctccagaaacaacgagaggtcacagataagcggaaagagactcagagccatggaaaggaaggtattgcagctcgagtgaggaattggcttggaaatgaaattgaggttatggtcagtactgaggaagccaaacgccatctgaatgacctccttgaagacagaaagatcctggctcaggatgtggttcaactcaaagaaaaaaaggaatctcgggagaatccacctcctaaactccggaagtgtacattctccctttctgaggtgcatggtcaagttttggagtcagaagattgtattacaaaacagattgaaagcctagagactgaaatggaactcaggagtgctcagattgctgacctacagcagaagctgctggatgcagaaagtgaagataggccaaaacaatgctgggagaatattgccaccattctggaagccaagtgtgccctgaaatatttgattggagagctggtctcctccaaaatacatgtcaccaaacttgaaaacagcctgagacagagcaaggccagctgtgctgacatgcagaagatgctatttgaggaacaaaatcatttttctgagatagagacagagttacaagctgagctggtcagaatggagcaacagcaccaagagaaggtgctataccttgtcagccagctgcaggaaagccaaatggcagagaagcagttagagaaatcagccagtgaaaaggaacaacagctggtgagcacactgcagtgtcaggatgaagaacttgagaagatgcgagaagtgtgtgagcaaaatcagcagcttctccaagagaatgaaatcatcaagcagaaactgatcctcctccaggtagccagcagacagaaacatcttcctaatgatacccttctatctccagactcttcttttgaatatatcccacctaagccaaaaccttctcgtgttaaagaaaagtttctggagcaaagcatggacatcgaggatctaaaatattgttcagagcattctgtgaatgagcatgaagatggtgatggtgatggcgacagtgatgagggggatgatgaggaatggaagccaacaaaattagtcaaggtgtccaggaagaacatccaagggtgttcctgcaagggctggtgtgggaacaagcagtgtgggtgcaggaagcaaaagtcagactgtggtgtggactgtagctgtgaccccacaaagtgtcggaaccgccagcaaggcaaggatagcttgggcactgttgaacagacccaggattccgaaggctccttcaaactggaggatcctaccgaggtgaccccaggattgagcttctttaaccctgtctgtgccacccccaatagcaagatcctgaaagagatgtgtgacatggagcaggtgctgtcaaagaagactgctccagctccctccccttttgacctcccagagtcgaaacatggagcaacagaataccaacaaaataagcctccagggaagaaaaagaaacgagctctggctagcaacaccagcttcttctctggctgctcccctatcgaagaagaggcccactgaagttggagtcatcatctctacccccaatctggcttgggagatgctttccagttgcagccagaaggggttttttaaatgacttctctggatttcaggtttcttgccgttgaaaaaaaggaacaaagcattactaaaaagaaggtaacctttgttggatgttgtccctcagtctccatccccagactactgctctctgctctctagaaggctgctaaaccacctgctgaagagagaaccaacagactttcctaatgactcatcaggaaccagtcctcagtatgatcaagttccttcttatttgtgagcagttcaggctatctcctgatggggatgaggccaaggctttcttatcttttggttgtctctgcttaatggaggagcctggcctaggatggaggtctggctcagatctttcactccacctcgggaatggggttgtgatctttcctgtcctgaccccctctgaattgtaagtgtttcaatagtactcttgattgtatgccatgttgttgaagtaaatgaattatttttaaatgttaagtaaataaaccttagcccatctactgtt

SEQ ID NO: 15435 - DNA, 5824 bp, Homo sapiens
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgcatttttttttttttttttttttggtggaagaagtctcagcgtctcttaggactgactgttcaaaggctcctcagcaaatgagcccttgaacagtcctaagagaccctgaggattctgtggagtagtttgaaaaccattgttctgaggaagggggtccaatctggctcctctgcactaaagctgcaactcatggaaaagagggcaacggtggggtagacaagccatgctgtctccagacccactagggtggaaggaaggttcctgtgggcctgtggacttaggctaatatttgctgtcagcagggcacttaagaatccagggggttttatgtaatgttgccaccacatggttcttttaaaaacacataaggaaatgtgagggtgtagcgcagatgaggagagagatgacacagagggagcagccttctctttagcaagatgtaagggaaatataattcacttacataaaaaagaaacaacacacacgcaaacccttcaccagaagcttcacactacatcctcctcctcctcctgctccccaccttcaccgcatccctttcagagccagggtcactgcaaggggcacctggcctgcccactcacatctgccaaaatgttgcatgccagcgtggaagacaaaccaaactgcgcaaccccctgtgtgtatttacttggtgtacatagataactttaaaataaaataaattcaatgataactct

SEQ ID NO: 15436 - DNA, 564 bp, Homo sapiens
aagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggca

SEQ ID NO: 15437 - DNA, 5877 bp, Homo sapiens
cgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaa

SEQ ID NO: 15438 - DNA, 6272 bp, Homo sapiens
gggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 15439 - DNA, 5867 bp, Homo sapiens
atggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 15440 - DNA, 6278 bp, Homo sapiens
atgtgggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 15441 - DNA, 6931 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 15442 - DNA, 585 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaag

SEQ ID NO: 15443 - DNA, 1330 bp, Homo sapiens
ctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacacca

SEQ ID NO: 15444 - DNA, 9082 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 15445 - DNA, 1220 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattaaaagcaccaagctcctctgatggagttctcttctgcagaaaccaatga

SEQ ID NO: 15446 - DNA, 3394 bp, Homo sapiens
atggcctctagtctgtatgacctcaagaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 15447 - DNA, 2488 bp, Homo sapiens
gggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctc

SEQ ID NO: 15448 - DNA, 3921 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 15449 - DNA, 2394 bp, Homo sapiens
acagtcctgaggggtgcagcgggtggcactggaagggcctcctcagcaggttgtcagccagctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 15450 - DNA, 743 bp, Homo sapiens
actcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattaaaagcaccaagctcctctgatggagttctcttctgcagaaaccaatgagtgaggcaggatctgtttcagcaaaggccctggtcaggtatcagcatcacacagtgttcctgctggagagaggagacagcatgcaaagtcaagattcaggtggaactgaactgctagggtggattttgttgctgtccctacccttccagaagccctatagcattacagtgctgaatgagaaagagagttaacaaagttattagccccaagacaaaaactagttcagaatttaaggaaaataaacatattagacattg

SEQ ID NO: 15451 - DNA, 8611 bp, Homo sapiens
ggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 15452 - DNA, 2361 bp, Homo sapiens
gggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcagtatcctttctgaagtgatgaagaaacttcctctatcctggtttgaaaggggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggc

SEQ ID NO: 15453 - DNA, 2258 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagtccaagatcaaggcactggcagattcgatgtctggactctaa

SEQ ID NO: 15454 - DNA, 1755 bp, Homo sapiens
ctcagcaggttgtcagccagctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttgaacccctggcttaaagtctcactcccctatcagagtgtggttcttgccaaagagctgtgagtgtaaacactgcttgaaggcccaggcccgaggacaccataacaatcacagaggaagtaagagtggcgtgtcagacaacaggaagagaagaaggctcttcttggtctgcatcactgccccctccacccccagccccgtcctcttggcagctgcccatctcccatctgctgtggctgggccttttctctttctgccttccatccccaacacacccacagggcaagccccagggccccttaccccaggcctgcattttgtcttagcctcctccccataacccaaaggctactaggcaggcttaacattgccttcacattgccagaaaggcgcccccaccgtgatggtatgggctggcagattcgatgtataatgactgatgcctgccctgtggcgcctgcactcagcttctccaccagccgtgtgcagtttgggcaggaagaggtttgtgcatggatggagcgccgcaactgagagccggccttggtcctgtactcgccttgcttggccgccagcctgcttatttactatcctctcttcaccaccaggaccagcagcctcagcaacactgtcaggtcctttcttaagcctgagacagccccacctctgctgtgatcttgtctcattctcagtttccttgtct

SEQ ID NO: 15455 - DNA, 4551 bp, Homo sapiens
ctggggatggaaacctgactgcctggcccgggacggcgcttgcagccaggcagggcccagagcagtcctccctcggcatggggctggaggctcagaggctgccaggggctgaggaggccccagtgcgggttgccctgcgagttcgaccactgctgcccaaggagctgctgcacgggcatcagagctgcctgcaggtggagccagggcttggccgcgtcactctgggccgtgaccgacactttggcttccacgtggtgctggccgaggatgcggggcaggaggccgtgtaccaggcctgcgttcagcccctccttgaggccttcttcgagggcttcaatgccactgtctttgcctatggtcagacgggctcagggaagacatacaccatgggggaggccagtgtggcctccctccttgaggatgagcagggcattgtcccgagggccatggccgaggccttcaagctcatcgatgagaacgacctgcttgactgtctggtacatgtgtcctacctggaagtgtacaaggaggagttccgagacctgctcgaggtgggcactgccagccgtgacatccagctccgggaagatgagcgcgggaatgttgtgctgtgcggggtgaaggaggtcgacgtggagggcctggatgaggtgctgagcctcctggagatgggcaacgcggcgcggcacacgggagccacgcacctcaaccacctgtctagccgctcacacacggtcttcaccgtgaccctggagcagcgggggcgcgcccccagccgcctaccccgccccgccccgggccagctgctcgtctccaagttccacttcgtggacctggcgggctcagagagggtgctcaagacgggcagcaccggcgagcggctcaaggagagcatccagatcaacagcagcctcctggcgctgggcaacgtcatcagcgccctgggggaccctcagcgccggggcagccacataccctaccgcgactccaagatcacccggatcctcaaagactcgctgggcgggaacgccaagacggtgatgatcgcctgcgtcagcccttcctcctccgacttcgacgagaccctcaacaccctcaactacgccagccgcgcccagaacatccgcaaccgcgccacggtcaactggcggcccgaggccgagcggccacccgaagagacggcgagcggcgcgcggggtccgccacggcaccgctccgagacccgcatcatccaccgcggccggcgcgccccaggcccagccaccgcctccgcggcggccgccatgcgcctgggcgccgagtgcgcgcgctaccgggcctgcaccgacgccgcctacagcctcttgcgcgagctgcaggccgagcccgggctgcccggcgccgccgcccgcaaggtgcgcgactggctgtgcgccgtcgagggcgagcgcagcgccctgagctccgcctccgggcccgatagcggcatcgagagcgcctccgtcgaggaccaggcggcgcagggggccggcgggcgaaaggaggatgagggggcgcagcagctgctgaccctgcagaaccaggtggcgcggctggaggaggagaaccgagactttctggctgcgctggaggacgccatggagcagtacaaactgcagagcgaccggctgcgtgagcagcaggaggagatggtggaactgcggctgcggttagagctggtgcggccaggctgggggggcccgcggctcctgaatggcctgcctcccgggtcctttgtgcctcgacctcatacagcccccctggggggtgcccacgcccatgtgctgggcatggtgccgcctgcctgcctccctggagatgaagttggctctgagcagaggggagagcaggtgacaaatggcagggaggctggagctgagttgctgactgaggtgaacaggctgggaagtggctcttcagctgcttcagaggaggaagaggaggaggaggagccgcccaggcggaccttacacctgcgcagaaataggatcagcaactgcagtcagagggcgggggcacgcccagggagtctgccagagaggaagggcccagagctttgccttgaggagttggatgcagccattccagggtccagagcagttggtgggagcaaggcccgagttcaggcccgccaggtcccccctgccacagcctcagagtggcggctggcccaggcccagcagaagatccgggagctggctatcaacatccgcatgaaggaggagcttattggcgagctggtccgcacaggaaaggcagctcaggccctgaaccgccagcacagccagcgtatccgggagctggagcaggaggcagagcaggtgcgggccgagctgagtgaaggccagaggcagctgcgggagctcgagggcaaggagctccaggatgctggcgagcggtctcggctccaggagttccgcaggagggtcgctgcggcccagagccaggtgcaggtgctgaaggagaagaagcaggctacggagcggctggtgtcactgtcggcccagagtgagaagcgactgcaggagctcgagcggaacgtgcagctcatgcggcagcagcagggacagctgcagaggcggcttcgcgaggagacggagcagaagcggcgcctggaggcagaaatgagcaagcggcagcaccgcgtcaaggagctggagctgaagcatgagcaacagcagaagatcctgaagattaagacggaagagatcgcggcattccagaggaagaggcgcagtggcagcaacggctctgtggtcagcctggaacagcagcagaagattgaggagcagaagaagtggctggaccaggagatggagaaggtgctacagcagcggcgggcgctggaggagctgggggaggagctccacaagcgggaggccatcctggccaagaaggaggccctgatgcaggagaagacggggctggagagcaagcgcctgagatccagccaggccctcaacgaggacatcgtgcgagtgtccagccggctggagcacctggagaaggagctgtccgagaagagcgggcagctgcggcagggcagcgcccagagccagcagcagatccgcggggagatcgacagcctgcgccaggagaaggactcgctgctcaagcagcgcctggagatcgacggcaagctgaggcaggggagtctgctgtcccccgaggaggagcggacgctgttccagttggatgaggccatcgaggccctggatgctgccattgagtataagaatgaggccatcacatgccgccagcgggtgcttcgggcctcagcctcgttgctgtcccagtgcgagatgaacctcatggccaagctcagctacctctcatcctcagagaccagagccctcctctgcaagtattttgacaaggtggtgacgctccgagaggagcagcaccagcagcagattgccttctcggaactggagatgcagctggaggagcagcagaggctggtgtactggctggaggtggccctggagcggcagcgcctggagatggaccgccagctgaccctgcagcagaaggagcacgagcagaacatgcagctgctcctgcagcagagtcgagaccacctcggtgaagggttagcagacagcaggaggcagtatgaggcccggattcaagctctggagaaggaactgggccgttacatgtggataaaccaggaactgaaacagaagctcggcggtgtgaacgctgtaggccacagcaggggtggggagaagaggagcctgtgctcggagggcagacaggctcctggaaatgaagatgagctccacctggcacccgagcttctctggctgtcccccctcactgagggggccccccgcacccgggaggagacgcgggacttggtccacgctccgttacccttgacctggaaacgctcgagcctgtgtggtgaggagcaggggtcccccgaggaactgaggcagcgggaggcggctgagcccctggtggggcgggtgcttcctgtgggtgaggcaggcctgccctggaactttgggcctttgtccaagccccggcgggaactgcgacgagccagcccggggatgattgatgtccggaaaaaccccctgtaagccctcggggcagaccctgccttggagggagactccgagcctgctgaaaggggcagctgcctgttttgcttctgtgaagggcagtccttaccgcacaccctaaatccaggccctcatctgtaccctcactgggatcaacaaatttgggccatggcccaaaagaactggaccctcatttaacaaaataatatgcaaattcccaccacttacttccatgaagctgtggtacccaattgccgccttgtgtcttgctcgaatctcaggacaattctggtttcaggcgtaaatggatgtgcttgtagttcaggggtttggccaagaatcatcacgaaagggtcggtggtaaccaggttgtggtttaaatggtcttatgtatataggggaaactgggagactttaggatcttaaaaaaccatttaataaaaaaaaatctttgaaggga

SEQ ID NO: 15456 - DNA, 2694 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaa

SEQ ID NO: 15457 - DNA, 734 bp, Homo sapiens
cggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacaggcccttccagtcacccgttgccttggcaatgtcatcaccaaccttttttggtgacagacccagggggccgatcttgggggccagggcagaagtggcaccgacttcacctctggtgcacctcagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaa

SEQ ID NO: 15458 - DNA, 734 bp, Homo sapiens
cggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacaggcccttccagtcacccgttgccttggcaatgtcatcaccaaccttttttggagacagacccagggggccgatcttgggggccagggcagaagtggcaccgacttcacctctggtgcacctcagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaa

SEQ ID NO: 15459 - DNA, 2706 bp, Homo sapiens
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaa

SEQ ID NO: 15460 - DNA, 2706 bp, Homo sapiens; identical to SEQ ID NO: 15459

SEQ ID NO: 15461 - DNA, 734 bp, Homo sapiens; identical to SEQ ID NO: 15458

SEQ ID NO: 15462 - DNA, 3362 bp, Homo sapiens
gagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacacaa

SEQ ID NO: 15463 - DNA, 3335 bp, Homo sapiens
agagatgagactgaggtttctcaccggttcctaagcccagtcagagctgtcaggtaattacagggtaaccgacagcccagagccaggcgggcgtggagccggagcgtcagtctcgccgggcgctccttccctgcgcccctgtctggaaaagaggagacctggaagccgggttaaactttaacacgggtcgggcacagagcagggggaatcagctgcattccctctggccaagctggtcagagctctgcgggctgccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 15464 - DNA, 3391 bp, Homo sapiens
gcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttac

SEQ ID NO: 15465 - DNA, 2729 bp, Homo sapiens
gaatcagctgcattccctctggccaagctggtcagagctctgcgggctgccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtgggcgtctctttggcagcaggaggtgctcgagcttgtcggggccaccaggtgcggcccccatggtgcttaggatggtggaggccatgtcccagctccaggacgagaagacccagctacaggaggagctggtggtcctacaggagaggctggccctccgcgacagtgaccagcaggccacgtccacccagctgcagaaccaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcg

SEQ ID NO: 15466 - DNA, 2770 bp, Homo sapiens
agaaccctgggccgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccg

SEQ ID NO: 15467 - DNA, 3047 bp, Homo sapiens
agtgtgagtgcatgtgcgccagcgcgtgcaaggacacggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaa

SEQ ID NO: 15468 - DNA, 3018 bp, Homo sapiens
agctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaagtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggc

SEQ ID NO: 15469 - DNA, 2294 bp, Homo sapiens
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtcc

SEQ ID NO: 15470 - DNA, 2524 bp, Homo sapiens
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgcctta

SEQ ID NO: 15471 - DNA, 2271 bp, Homo sapiens
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtcc

SEQ ID NO: 15472 - DNA, 2393 bp, Homo sapiens
ggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgcttta

SEQ ID NO: 15473 - DNA, 2322 bp, Homo sapiens
gagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacag

SEQ ID NO: 15474 - DNA, 2558 bp, Homo sapiens
gcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 15475 - DNA, 2063 bp, Homo sapiens
ggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaagcgtgccagctctctgaatgtccttaacgtgggtggcaaggctgctgaagatcgctttcaagaacgaaataattgtctggccgactcgcgagctctgagtgccagccacactgacctggcccactga

SEQ ID NO: 15476 - DNA, 2453 bp, Homo sapiens
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgcctta

SEQ ID NO: 15477 - DNA, 3135 bp, Homo sapiens
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaa

SEQ ID NO: 15478 - DNA, 976 bp, Homo sapiens
atgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaa

SEQ ID NO: 15479 - DNA, 2467 bp, Homo sapiens
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtaca

SEQ ID NO: 15480 - DNA, 540 bp, Homo sapiens
ataattcattcactcgcctcccactgggagtccacaatggcctaatgcacgtttcaagctcttggtttctatcaaacggctcgctcaagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagttt

SEQ ID NO: 15481 - DNA, 2265 bp, Homo sapiens
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtaca

SEQ ID NO: 15482 - DNA, 2990 bp, Homo sapiens
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctga

SEQ ID NO: 15483 - DNA, 2591 bp, Homo sapiens
aggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 15484 - DNA, 2898 bp, Homo sapiens
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggc

SEQ ID NO: 15485 - DNA, 3015 bp, Homo sapiens
gcgagccagataacagcggcactcacttctcgggtcttcgtgagcattaagtcaatgaacccagggcaccaaagcgcgcaacacgcagtaggcgctcagttagtggcgcctcgctctgtactccaggaagcccaaccttctccctgcgcctcagtttctcccgacgtcctcgatggcgccatggcgccacactaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 15486 - DNA, 2721 bp, Homo sapiens
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 15487 - DNA, 620 bp, Homo sapiens
ctcgatggccccgccccgtccccctcccgctggagccggcccggcccgcgctcctttaaggcagcgaacgggccaagagaagcgtgtttcgccccctccgacgccaccgagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgac

SEQ ID NO: 15488 - DNA, 643 bp, Homo sapiens
ggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctc

SEQ ID NO: 15489 - DNA, 1073 bp, Homo sapiens
gccttttcagggaaggcctcagggcgttgcgctggcctaggggaggggtcgtcgtgggcgtagcctggaaggactgggggccgcgtactcagcccctctagtgggagcgcctccgcagggtcggctcgtcgggaggatgggctccgcggcttggcctgccttttggggatggggctgtccgaggggctgggcccggatcgccggaggggccagggtctcctgcacaggagtgagcccccacgttccccatacctgtcctggttagggggtccccggggaaacccggacactgagccgcctaagtcggcctgagccggtggtctggggccgaagcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgagg

SEQ ID NO: 15490 - DNA, 594 bp, Homo sapiens
ctcgatggccccgccccgtccccctcccgctggagccggcccggcccgcgctcctttaaggcagcgaacgggccaagagaagcgtgtttcgccccctccgacgccaccgaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaag

SEQ ID NO: 15491 - DNA, 559 bp, Homo sapiens
gcgagccagataacagcggcactcacttctcgggtcttcgtgagcattaagtcaatgaacccagggcaccaaagcgcgcaacacgcagtaggcgctcagttagtggcgcctcgctctgtactccaggaagcccaaccttctccctgcgcctcagtttctcccgacgtcctcgatggcgccatggcgccacactaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggaga

SEQ ID NO: 15492 - DNA, 1780 bp, Homo sapiens
cgcccggcgcagcgggagcggcggggcgtgcctggcctgcgggacgcgactgatcgcagtggggcgaagcggggccggagccgcccgcggtcaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 15493 - DNA, 1820 bp, Homo sapiens
aggatgggtggagcagggaagagccaggatggggagaagttaggggtcctgatggccattatgggaatagaggctgggggccaactgactggcccgggcaatgattccccaaacccctcaccattgctccccaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 15494 - DNA, 2957 bp, Homo sapiens
aggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 15495 - DNA, 4111 bp, Homo sapiens
attctttttctagtctctgttgctgctttttattatttccttctgctagcttggggttttgtttgctcttctttttctagccccttaaggtgtaaaattaggttattaattcaaaatcttttatttatttttttaaatagagcgtcagtatagagtgtcttattgtggatctgtttgagtttatctttgaatttcattgagcttcttggatgtgtaagtttgtctttggtctaatttgggaagtttttgactgttttttctcccagtattctctatgtttctttcttcctctcctttcataccctcattatgcatatgttggtatactagatggtgttccataagtctcttaggttctgtttatttttcttcattctgttttctttctgtgcctcaaaatggacagtttcatttgacatatcttcaagtttgctgattcttttctctctctgctcagatctgctgttaaaaaccctgtagtgatttttttatttcagttattgtacttttcagatctagtgtttttgtttggatccttatgataatatatttttaaactatttatgtgttgagacattgtgtttctcctttttcttagttatttgcactggtttctttttgctctttggacatatttaagacagttgatttaaagtctttgataagtccagtgtttgtgctgtagcatggacagtttctgttaattttttttattgtgagaatgagaatgagtttcttgtttctttgcatgtttcatattttgttttgttgaaaactgggtattttgaatattatggtatccaaaggaaaaaaagaaaagaaaaaaatactcttcagatctttgtaggttgactcagtgtttggatatggcttcaacacttagccaggcaatttacaattttaccttagccttcatttgctgcttgcacagagcctgaagaccagccagaggtaaaagcttatgatcttcccaggttttttctgggtatgtattctgccctgagcatgctcatggatttctagatttctctttatatgcaatagcttttcaaagcatctattcccccaaaatgtctgactccctggactttcctcttgggctttcagcttgtgttttgtttgacccagctattactatttatcccaggggccagcagcttgtatgcttggctttcactgatttcagtgactgcatagctgcactatcctgataagagtttaaaattagtcaaaacaaaggaaagccccttgcagctgacctcaaaggaaacttcagtcagttgcaaaacaatcagacaaaattccttgggagcaaggtccacttgactcctctagaaccaagtattaacagtgggaacgtgggctgccatcttgaagactgccactgtgcttgagagtggggtggatgtctagggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 15496 - DNA, 2718 bp, Homo sapiens
ttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaagcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 15497 - DNA, 3015 bp, Homo sapiens
aggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagattgggaagggtcagcaggacttctgaagagggaacacgacctttaaggaggccaacagatcaggagaaggcaaaagggatgtcgattgcccttggcaacacttaccggagaagtctttcagattcagaaactgtttctgtactccaagcaagcttatgtgaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccac

SEQ ID NO: 15498 - DNA, 1956 bp, Homo sapiens
aacataaattttagaaggacagtattcaaccggctacctctatcttggctgtaaagagaagtctgtttgttttttcaatttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtg

SEQ ID NO: 15499 - DNA, 3435 bp, Homo sapiens
aaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccatacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaa

SEQ ID NO: 15500 - DNA, 1720 bp, Homo sapiens
ttttcaaatgcaaatgagcaggttaacaaccccagtgttgcaatgttctagctgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaa

SEQ ID NO: 15501 - DNA, 1538 bp, Homo sapiens
atttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaag

SEQ ID NO: 15502 - DNA, 1391 bp, Homo sapiens
ccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcac

SEQ ID NO: 15503 - DNA, 608 bp, Homo sapiens
atggacatccccatcagcagcagagacttccgcggcctgcagctggcctgcgtggctctcgggctggtggctggcagcatcattatcggcatctccgtatccaaggctgcagctgccatgggcggtgtctttattggcgctgctgttctggggagcctaagaatccatccccatccaggggcagaccacggggaaggaagatccagcaccaatggcaacaaggaaggagcccgcagcagcctgtccaccgtgagcaggaccctggagaagctgaagccggggacccggggggctgaggaatgctgaggcaaagtctgagcggctgcccatgccctgccctcccatcctgcctgctgcccctatgtcagtgccctcctgggttaggagacccggaccggagacaagccaggccctgcagaccccagagcggctgggaacagtgtctggaatggggccttttgcactcgcccggccaagcctctccaaaatggattccactggtgtgggctgggacctggagcaaggtgtcgccggacgcccccacagggttcccatgtttcaggctcctgccctggcctttctttctggactgcagctcagctttgttg

SEQ ID NO: 15504 - DNA, 1037 bp, Homo sapiens
gccaaagcagaaatgtagccagacaggagtcccaagggtgggcttcagcttcagagggctttgagagaggaagagtaagctgggtgacctcgtacagatccctggtcaaggtgggactggggggcccgtagtggagcagtggaataggactgcagataaatcccagggttccccacctatcatcttactgcccagaaactcctaccctgaagttggagcgccaacaaggagacatccaagagcccagaaacttccaggacttttctggggccagactgcaccggctggaggcagtgccccgggtgggcctgcatggacatccccatcagcagcagagacttccgcggcctgcagctggcctgcgtggctctcgggctggtggctggcagcatcattatcggcatctccgtatccaaggctgcagctgccatgggcggtgtctttattggcgctgctgttctggggctcctcatcttggcctaccccttcctgaaggctcggttcaacctggaccacatcctgcctaccatagggagcctaagaatccatccccatccaggggcagaccacggggaaggaagatccagcaccaatggcaacaaggaaggagcccgcagcagcctgtccaccgtgagcaggaccctggagaagctgaagccggggacccggggggctgaggaatgctgaggcaaagtctgagcggctgcccatgccctgccctcccatcctgcctgctgcccctatgtcagtgccctcctgggttaggagacccggaccggagacaagccaggccctgcagaccccagagcggctgggaacagtgtctggaatggggccttttgcactcgcccggccaagcctctccaaaatggattccactggtgtgggctgggacctggagcaaggtgtcgccggacgcccccacagggttcccatgtttcaggctcctgccctggcctttctttctggactgcagctcagctttgttgcctgttcaatctactgatttgtttctctggaatttggggtccaaggcc

SEQ ID NO: 15505 - DNA, 6082 bp, Homo sapiens
atcctcagtctcccagttcaagctaatcattgacagagctttacaatcacaagcttttactgaagctttgataagacagtccagcagttggtggcaaatgaagccaggctgtgcggcaggatctccagggaatgaatggattttcttcagcactgatgaaataaccacacgctataggaatacaatgtccaacgggggattgcaaagatctgtcatcctgtcagcacttattctgctacgagctgttactggattctctggagatggaagagctatatggtctaaaaatcctaattttactccggtaaatgaaagtcagctgtttctctatgacactttccctaaaaactttttctggggtattgggactggagcattgcaagtggaagggagttggaagaaggatggaaaaggaccttctatatgggatcatttcatccacacacaccttaaaaatgtcagcagcacgaatggttccagtgacagttatatttttctggaaaaagacttatcagccctggattttataggagtttctttttatcaattttcaatttcctggccaaggcttttccccgatggaatagtaacagttgccaacgcaaaaggtctgcagtactacagtactcttctggacgctctagtgcttagaaacattgaacctatagttactttataccactgggatttgcctttggcactacaagaaaaatatggggggtggaaaaatgataccataatagatatcttcaatgactatgccacatactgtttccagatgtttggggaccgtgtcaaatattggattacaattcacaacccatatctagtggcttggcatgggtatgggacaggtatgcatgcccctggagagaagggaaatttagcagctgtctacactgtgggacacaacttgatcaaggctcactcgaaagtttggcataactacaacacacatttccgcccacatcagaagggttggttatcgatcacgttgggatctcattggatcgagccaaaccggtcggaaaacacgatggatatattcaaatgtcaacaatccatggtttctgtgcttggatggtttgccaaccctatccatggggatggcgactatccagaggggatgagaaagaagttgttctccgttctacccattttctctgaagcagagaagcatgagatgagaggcacagctgatttctttgccttttcttttggacccaacaacttcaagcccctaaacaccatggctaaaatgggacaaaatgtttcacttaatttaagagaagcgctgaactggattaaactggaatacaacaaccctcgaatcttgattgctgagaatggctggttcacagacagtcgtgtgaaaacagaagacaccacggccatctacatgatgaagaatttcctcagccaggtgcttcaagcaataaggttagatgaaatacgagtgtttggttatactgcctggtctctcctggatggctttgaatggcaggatgcttacaccatccgccgaggattattttatgtggattttaacagtaaacagaaagagcggaaacctaagtcttcagcacactactacaaacagatcatacgagaaaatggtttttctttaaaagagtccacgccagatgtgcagggccagtttccctgtgacttctcctggggtgtcactgaatctgttcttaagcccgagtctgtggcttcgtccccacagttcagcgatcctcatctgtacgtgtggaacgccactggcaacagactgttgcaccgagtggaaggggtgaggctgaaaacacgacccgctcaatgcacagattttgtaaacatcaaaaaacaacttgagatgttggcaagaatgaaagtcacccactaccggtttgctctggattgggcctcggtccttcccactggcaacctgtccgcggtgaaccgacaggccctgaggtactacaggtgcgtggtcagtgaggggctgaagcttggcatctccgcgatggtcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctggtggcccacgccctggcctggcgcctctacgaccggcagttcaggccctcacagcgcggggccgtgtcgctgtcgctgcacgcggactgggcggaacccgccaacccctatgctgactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgccgcgcctcaccgaggccgaaaggaggctgctcaagggcacggtcgacttctgcgcgctcaaccacttcaccactaggttcgtgatgcacgagcagctggccggcagccgctacgactcggacagggacatccagtttctgcaggacatcacccgcctgagctcccccacgcgcctggctgtgattccctggggggtgcgcaagctgctgcggtgggtccggaggaactacggcgacatggacatttacatcaccgccagtggcatcgacgaccaggctctggaggatgaccggctccggaagtactacctagggaagtaccttcaggaggtgctgaaagcatacctgattgataaagtcagaatcaaaggctattatgcattcaaactggctgaagagaaatctaaacccagatttggattcttcacatctgattttaaagctaaatcctcaatacaattttacaacaaagtgatcagcagcaggggcttcccttttgagaacagtagttctagatgcagtcagacccaagaaaatacagagtgcactgtctgcttattccttgtgcagaagaaaccactgatattcctgggttgttgcttcttctccaccctggttctactcttatcaattgccatttttcaaaggcagaagagaagaaagttttggaaagcaaaaaacttacaacacataccattaaagaaaggcaagagagttgttagctaaactgatctgtctgcatgatagacagtttaaaaattcatcccagttccatatgctggtaacttacaggagatatacctgtattatagaaagacaatctgagatacagctgtaaccaaggtgatgacaattgtctctgctgtgtggttcaaagaacattcccttaggtgttgacatcagtgaactcagttcttggatgtaaacataaaggcttcatcctgacagtaagctatgaggattacatgctacattgcttcttaaagtttcatcaactgtattccatcattctgctttagctttcatctctaccaatagctacttgtggtacaataaattatttttaagaagtaaaactctggggctggacgctgtggctcacacctgtaatctcagcactttgggaggccgaggcggggagatcacctgaggtgaggagttcgagaccagcctggccaacatggtgaaaccatgtctctactaaaaatacaaaaaattagccaggcgtggtgacagtggcacctgtaatcccagctacttgggaggctgaggcagaagtttgaacccaggaaacaggttacagtaggccaaaattgcgccactgcactccagcctaggcgacaacagcaagactgtgtccaaaaaaaaaaaaaaaagcaaaagcaaaactttgttttgttagactctacagcagagatttaacacccttctttaaactgggtagtcagtgatagataatatatattctgtcacttctaataaggtgccttctcctttaggtcagggtggttctaaaatggaaagaaaacacaatagggtaagtagtgcttgtctaagccagttacaacacagactcttaaagaggatcaagcccttcatttttctaacaacaaaaaatcacctatagaatatctaatttgtgatcttttactagatctgattttttaaaataatgtaatttccggccaggcacggtggcaccgcctgtaatcccagcactttgggaggccaaggcaggtggatcacctgaggttaggagttcgagactagcctggccaacatggcaaaaccccatctctactaaaaatacaaaagttagccgggcatggtggtgggcacctgtaatcccagctactcaggaggccgaggcaggagaatcgcttgaacccgagaggcagaggttgcaatgagccaagatcgtgccattgcactccagcctgggggacagggcaagactgtctctcaaaataaaaaaaaataataaaaataaaaataaaagtaatttccaaaacctcatctcatggaaagatcacaggatgaaggaaagctagactcaactctgtgaatagaagttgctatactgtaagtaaagcaacaattcagaatactgaatgagtttaaattgttttatatagcacccttttgggctagggttaattactagatctgacttggataatttgacactttgggaaatgaactctgttcttgagacttgttcagtgtattttaaacatctgaggaagaaaacttaaatatgcacctatttatacctattctttctttaggtcaacatttaacacccactgcatacattaatttgtccttgtctgctcactccagcaatttagaccttaacagtcacaagagacgttcttctgttacaaagccttagtaaattaaggcagttttgattatattctaggtccacctatgtctgaagctaaattcagtatctaactgctaatgaacaagtttccaaaatactgtaaaaatacaattagtcaatttgagtaaatgcaaatatgatgagaaatcaatttgctatttggcctggcaaatgggaacagtaaaattctgctttactcttctctagtctccttgccccagctgcacccactaccccaaagttggcagttttgaggtatgattttcaaggaatttttttagtattaacatctccctctgagaactatgtacctaaggtcacgcatacaactagtcaattctgtttttattactctaactatgtagaaacagtaagtcacttaaaacaatcacttggctgggttttttcccctttgtgccacattgattcaccctgacccaagaactccagggaaaattctttaatgtcaactgggcaactcattaacctctctttaacatcaagggcttgggaaaaaaaaaaaaaaggttagccacaggaataacaaaaacctggaatttatctttcaggttttgctttctctttctcactttgtttaaagtatctcgtactcacagttcacaaattaaccttcactgtctctttcacattaagagcttatgcttaaagcatgccccccttttctaacttgctggtttaccataaactcccctaagtaataaaattcctaacccagtactgagagtcctccttctctgccacttgggcattattttactagtttttaagccatcatcgcacaagaatccaaaaacccttaaattttttaaccactggcaaatatgtacagcaaattaggttaagcatttaatctggctcatgctctatcatactaaatattcaggtttatcataaactccttaaaaaccatcaaaggtcaaccagaaactgataactcttgaaaggagcaaacaggtaagatctttggagtttaagcttttctgagatgtgttgtgaaaaatctaacgtgtttatcgtatattcaatgtaacaacctggagaatcacaactatatttaaagagcctctggaaaatgaggccagtacagtgtgactacatgtttaattttcaatgtaatttattccaaataaactggttcatgctgaccacttgtattcaactaacaa

SEQ ID NO: 15506 - DNA, 2111 bp, Homo sapiens
gttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgctgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggta

SEQ ID NO: 15507 - DNA, 1879 bp, Homo sapiens
agagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggta

SEQ ID NO: 15508 - DNA, 1877 bp, Homo sapiens
agattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgctgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggt

SEQ ID NO: 15509 - DNA, 1798 bp, Homo sapiens
agattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggt

SEQ ID NO: 15510 - DNA, 3378 bp, Homo sapiens
gagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaa

SEQ ID NO: 15511 - DNA, 4075 bp, Homo sapiens
ggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttttttttttggtggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatatagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtcgatgaaatcaagagtgtgatgttctagttatttttttttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactggga

SEQ ID NO: 15512 - DNA, 4030 bp, Homo sapiens
gagggccgcgccggggcagagccgcgcgggcgggcgaggcgcgtgccggccgcaggagctccgggttgccgccgccgccgccgcccgcagcccacgtgcggccgctgctgcgcccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 15513 - DNA, 4033 bp, Homo sapiens
ggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 15514 - DNA, 3885 bp, Homo sapiens
actcgcgcgcctgtaaatgcgggaggtggggcgtgcagggcttcgctgcggccgcgccggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 15515 - DNA, 1483 bp, Homo sapiens
atttcagttcatttgatgagaaaacatgtcaaaaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccattt

SEQ ID NO: 15516 - DNA, 1617 bp, Homo sapiens
ggggctttgtttctggggaggaggacccggagctcttttgtttgggggtttcttgttttcggccccccccctcacagcaccccaccccaccccaccccaagcgcctctccggtttcctgagctgcgggctgcgagggaggagaagcggcgtcctgcaaccccctcggctgggccccggggtaattcgatgcgggcctggcgaggctccccacactagaccggggctcgcaactcggcagcctccacccaccggcccaccctacatttagcgcatcatgtgatccgggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacaca

SEQ ID NO: 15517 - DNA, 10637 bp, Homo sapiens
aatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattacaaacacttgattttgggaattgcacatattaacctcacaatattactagctcatttttaaatgtctggacattctgaaataatttccggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcagatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccagggagactgcttttaggtataactacatgttgacaagattaagtgctgtggatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagacggaaatgtaccaggataagggggtaaaataaccaattaagtgtcaaaggaaagctgctgggttccttaatctcactgaagtcaagtcttctgactgggcttcttaccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaa

SEQ ID NO: 15518 - DNA, 6825 bp, Homo sapiens
cggcagctgtcccgcctgccacaatgcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 15519 - DNA, 2574 bp, Homo sapiens
ggggagtgagtgcccagcgagctgcgggcgggctagtgctccgccgcagcgacccgcgggccggcgggcgatcgagccagcgcaggacccgcggctcggcccccggccgccgccggaccgagagtctagccgccgcccccagcccagcccgcccggccgcaggaccgccggggcctggccgccggtccggcgtgcgccaagttcagccgccaccggcacggccaggccagcatggtggaccacttacttccagtggacgagaacttctcgtcgccaaaatgcccagttgggtatctgggtgataggctggttggccggcgggcatatcacatgctgccctcacccgtctctgaagatgacagcgatgcctccagcccctgctcctgttccagtcccgactctcaagccctctgctcctgctatggtggaggcctgggcaccgagagccaggacagcatcttggacttcctattgtcccaggccacgctgggcagtggcgggggcagcggcagtagcattggggccagcagtggccccgtggcctgggggccctggcgaagggcagcggcccctgtgaagggggagcatttctgcttgcccgagtttcctttgggtgatcctgatgacgtcccacggcccttccagcctaccctggaggagattgaagagtttctggaggagaacatggagcctggagtcaaggaggtccctgagggcaacagcaaggacttggatgcctgcagccagctctcagctgggccacacaagagccacctccatcctgggtccagcgggagagagcgctgttcccctccaccaggtggtgccagtgcaggaggtgcccagggcccaggtgggggccccacgcctgatggccccatcccagtgttgctgcagatccagcccgtgcctgtgaagcaggaatcgggcacagggcctgcctcccctgggcaagccccagagaatgtcaaggttgcccagctcctggtcaacatccaggggcagaccttcgcactcgtgccccaggtggtaccctcctccaacttgaacctgccctccaagtttgtgcgcattgcccctgtgcccattgccgccaagcctgttggatcgggacccctggggcctggccctgccggtctcctcatgggccagaagttccccaagaacccagccgcagaactcatcaaaatgcacaaatgtactttccctggctgcagcaagatgtacaccaaaagcagccacctcaaggcccacctgcgccggcacacgggtgagaagcccttcgcctgcacctggccaggctgcggctggaggttctcgcgctctgacgagctgtcgcggcacaggcgctcgcactcaggtgtgaagccgtaccagtgtcctgtgtgcgagaagaagttcgcgcggagcgaccacctctccaagcacatcaaggtgcaccgcttcccgcggagcagccgctccgtgcgctccgtgaactgaaagcgccctgaaccccagcctgtccgtcaccccggatccccaccccatccccatttttttaagcaataatttatttgcctcctccagagggacatggcaatgttaccagcccaccttctgaagcctgggaggtgtgaacccagggcccgccaaccgctgcctttctcgggagtacttagagcctcgaacccgcgtccctgggggctgggccccaggcgcacggggctggaggcaggccttcgtgccttcgtgccttcgtgccttcccgcggtggccaggcctctgctgcagccgctggttgcaggcagagttttggggacctggcccttctcccactgggctcccccatcctgggccaaggccagaactttagtgctaggggaagatgaaatgtgcagttttgaaatgttgggtttccagagagagtcatgctggaggagaaggaagtaggccagaagtccagggctgcactgtggtgtgagggtggctttgtctaagatgcctgctcagcatgatcaccagagggtgtgggcaggtccctggagccgggggggggggggggggggggggggggcaggaccgggccgctgggccctcatgtgggagagaggtgaaaagcgtcccccactagggggctggcagtgcatgtgcttgagttaaatgtgcagggcagacagagccagaagggcctgtacccaggggctcgtcccctcctccggtttcccagacaaatccagacaccagcctttagggtggccttgggaggagagggccaggctgtcctgggtgtgagagaactagatagagcctcccaaccctgatttagaaatgcattccttattttgtctagaaattaataaatgaactagcttgttttgacaggtttatttcacatcctatgaatgtatgtaaataaactgtacataggtccatccacataaaatatcttttaataacatatcaacatttgtgtaaatttgaaatttaaaaaaatctatgaagctggtgtacatatgttacaattacgtatattttctttggtccttcataaaaatatatttactttgccaataaaaagaaaaagaactcaca

SEQ ID NO: 15520 - DNA, 1647 bp, Homo sapiens
gcccgcccgcgccccgaccagcccggcctcgggcagccactcaccggtgtccccgtccgcgtcctttctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatctttt

SEQ ID NO: 15521 - DNA, 420 bp, Homo sapiens
ccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaatctgtggaccaaaatcattggctcgggagaaaaaggaggaatccgaactga

SEQ ID NO: 15522 - DNA, 2169 bp, Homo sapiens
ttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgctatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccct

SEQ ID NO: 15523 - DNA, 4656 bp, Homo sapiens
ggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgcca

SEQ ID NO: 15524 - DNA, 4537 bp, Homo sapiens
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgcc

SEQ ID NO: 15525 - DNA, 8362 bp, Homo sapiens
agcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttccttttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaacaaaataatacaaaacgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctattttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagccgagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaacccggcctggtgtttctggtggtgtcctaacaagcacgcttttatccagggttcagatttgttcatgtagaaaaagagtttctaagccactgacaattttttttttttgtaatttcaaattatacttctttctcctgccacatgactgtaagtcatagacatggaaacctgaaattataatgctgctcctagctactggcctcctgccccacccatggttaatggctcagctcaatgcctggtggtaatgagtattatgtccagaaaaagagatgttcagattccatgacaaagctgcatttttgtaaaaatattggagaccccaaaatgaacttcatgctgaccatttcctcctctctgtgtgctttcccttgcaaagcccttcaaatatcctcttctctcgacgccatctcctctccacctgcacctcttgtgccctttgtacatctttgattgcctgatgataacagggtaaaaggacagccaacctcatgcctgattagcagaactgaatcctagttttaaaaaatcttctctggcttcagagaagattttataaggacttttgtttgggataagctttccagattatccatgtctatttgcatcaaaggggaaagaaatggggcttttggatggctcttccagtgcattcggaacattgcctcttgcctttattcctgcattttatggcaaagccaaaagaaactcaagttgcaagaacaaaacccagtgactcgttttgatggttcaaaatggtttcctttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatcccagaaaagggaaaaataaagctgcagttaactttcttatgtgcatccttccaatagagtactgtatttttcaggtgttttgcatttaacataaaagtcctcgggaaacaggtgtcaaaaacagagagagaaatcctgggccatcacttcacaaatatcccaaacaagatattcttttcaaacagggctccctctcagtggtcatgagggaaggttgataatgttctttgttggggactgtttatacaattttttttcaactgtgagctttggaatcgtaacttgctgtgagtccagcttctgtctactgccataagatggaccccacgtcagcataatgagggtggtatatatgctcgcacctagacatgcgcatatgtacctgtcgtaccttcacggaaggaaaacaggctactgacgtttcggaggagtagccaccagtgcctaatatcttttgggggggatggatgcttataattgccagtatatcgaaaccacactgggagttccacatagcggggaggggttgggggtgggcagaggggacattttaaacctaggcctttggactggaggcagaacgatttctgcaaacctaggtcctgaaggctttggggcttattggctggttctcaacctttttgttttttcttcccagcatgcatttcctatctaaacccagacttagtttaatttccttatctttcacttctgcttcattccagggaggaaaaatacacctgttaatggccaagatctccttgctaacacagaggcaaaaataaatgtctaatgtttttgaagcctccccttcctttccacaagcccccacccgcccccgcgtcaagctccttctcccacttcctactcccacacaacttcccagccactgaaacttttctttcaaatctctattatcctcttaacagttgcttgaataaatttatttttgcactatacattttctttttgccagatgtgtctaacaagtgtgtttggagagacctactcccagccccgtctccttccccgcctccccccgtcacattctctcaggccttctctggtatttataatatatcacagaagtacccagtcttatagccctcggttatgcctttttttgacattttattttttttaagctttttatatatatatatatataaatatattactttgtcaagtttttttgctgtacaaaagtcttaagatttaaaactattatttgtattatatgatggtggtatgttaatgttacaaaattattaatgaagaaaaaatttatttttgttactggtctgtttcataattcttttttaaattggtatattgtaagatatctatgcaaaaaatgttatgtgacgcatttttatttaagaatgtaatatgtgtaataaacagtagaatgtgtttggccttggaatactttactgtatttctccttagcttgtttcactggggaaaaaaatcttcgaaagacgcaagtgggtacttacatacttcgtgaaagttttctttcttggagaaagggaaagcaaaaggttgtattaggttatcttcgtttgggaagttgtgtgtgtgtgtgcgtatgtgtgtattttatagtttcattgaggcagctcaatgcccaaataagggtcactgagtttatttcttcaaggggaaaaagggagccaattgttggagattatgaaaagcaatattttagaatgatagagattacaagatgttatttgtttagggggttgggagaggcttattgaaagcggtttatttggcgagagaaggaggcagtttgttctgggatggtgtttaataggaacctattgggaaaggatctttgaagcagtctgtgaaggaggaagggtaaagatcagagggaataatttaggtgaggggtagggggcagtaaaatgacaggaggtggttggagtggggaggaaatgggtaaccggaagccaggaaatccagctggctgtggagagtacaaaaaactagatggaaatacaagcagcttcagacccagagaagagagggagatgaaagccccagggaaaattctcagaactgaaaagaaaagtactaaaatctctgccacacacgacttccaggaaagagcatcaccagtaaggaggaaggtagagaacccagctggtggtgtcgcctcagcatcccgagctcagcgattccccgagagaagtggtgtcattcacaggaaacagcagtaaaacacatttgtcacatgggacacagcagtagtcaagctttctttgcattctttggacttacagaagtggatacggtggtgaataacctctatccctaatcaaatgaatctgacaagaaactttccaataaatgtttactttagaaa

SEQ ID NO: 15526 - DNA, 1259 bp, Homo sapiens
gatttgggagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccga

SEQ ID NO: 15527 - DNA, 3037 bp, Homo sapiens
agatgtaacagatctctctatgtctacatcccaactccagaaaacgagaaatcgagttcctcctctcaccatcgaagctctgcagacacctcgctggagaccccatgacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttccttttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaa

SEQ ID NO: 15528 - DNA, 750 bp, Homo sapiens
acacgcggcctaatggacgccctcctcgagatcccacggctgcgcggagaaccgaacggagggagggagtttggggagggggaagagcaggaggaggagaaaagggagggggaagactacaaactagcaaggatggggtggggggtggggagggaagggaaggggggggaagagaagcgatcgcgagagaaaaaaatgcaacctcccaaaataaagagcaaagattgcattaggagcgaacagcgctgcagaaatagatggcagcttcgtgtcattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctcca

SEQ ID NO: 15529 - DNA, 594 bp, Homo sapiens
attgtgcagggttttcatctcagatgtaacagatctctctatgtctacatcccaactccagaaaacgagaaatcgagttcctcctctcaccatcgaagctctgcagacacctcgctggagaccccatggtgagcctcatcacgtaaaggccccctcgcaagctgccggctccagcttgcgccccacgtctacctaggctccctctagcctctttaacgcacagtcgagcaacaggccccttgcaatcaactctagccgccggactcccgaccagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgttt

SEQ ID NO: 15530 - DNA, 539 bp, Homo sapiens
agcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcact

SEQ ID NO: 15531 - DNA, 4821 bp, Homo sapiens
tcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtgcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagagagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaa

SEQ ID NO: 15532 - DNA, 1543 bp, Homo sapiens
cccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagaaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatat

SEQ ID NO: 15533 - DNA, 2934 bp, Homo sapiens
gagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaagga

SEQ ID NO: 15534 - DNA, 2732 bp, Homo sapiens
atgcagccccggaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaagg

SEQ ID NO: 15535 - DNA, 985 bp, Homo sapiens
gccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagccgtcgccgcccccgagaggccgtgcgggctgcaggggccccggtgcctccgaggcagcgcgtgggcgaggggtgcgcccgggccccagggccccaggcagcccggcttgccatgggcatccagggcatggagctgtgcgccatggccgtggtggtgctgctgttcatcgccgtcctcaagcagttcggcatcctggagcccatatccatggaagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctag

SEQ ID NO: 15536 - DNA, 952 bp, Homo sapiens
aagcctgacgttgctacgattctgtaattaactccctccactccaaaggggtctggaggctgggatgctctgccagctcagaggatgttgactctggagtgggagtccgaaggactgcaaacagtgggtattgttgtgattatatgtgcatctctgaagcttcttcatttgctgggactgattgatttttcggaagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttca

SEQ ID NO: 15537 - DNA, 2481 bp, Homo sapiens
aactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtt

SEQ ID NO: 15538 - DNA, 1645 bp, Homo sapiens
aatgtagtttaatggctttacaaagaaagccaggcagaggagcacttctcagtggctgtggtcggaccatgacctagctgaccatgaacttggaagggcttgaaatgatagcagttctgatcgtcattgtgctttttgttaaattattggaacagtttgggctgattgaagcaggtttagaagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataaca

SEQ ID NO: 15539 - DNA, 1767 bp, Homo sapiens
ctgcagcccgctccgcgcgccctgcccgcagccgccgccgaagctctcgctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcct

SEQ ID NO: 15540 - DNA, 1538 bp, Homo sapiens
gtttcctgtacgctcagaacagcaccaagcgcagcattaaagagcggctcatgaagctcttgccctgctcagctgccaaaacgtcgtctcctgctattcaaagcaacgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcct

SEQ ID NO: 15541 - DNA, 1641 bp, Homo sapiens
agcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcgacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagta

SEQ ID NO: 15542 - DNA, 1301 bp, Homo sapiens
aagatggaggctctgtgtgagaaggaatgcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaactacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttga

SEQ ID NO: 15543 - DNA, 609 bp, Homo sapiens
aggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggctgctgagtcactcagaaatccttcaaacatgattaattatgaagatgaaacactagagtcatataagaaataaaaattgggcaataaaataaaa

SEQ ID NO: 15544 - DNA, 4888 bp, Homo sapiens
gacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagaggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagcta

SEQ ID NO: 15545 - DNA, 1868 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagta

SEQ ID NO: 15546 - DNA, 5261 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagcta

SEQ ID NO: 15547 - DNA, 1751 bp, Homo sapiens
atttgcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgaaaacttggtggagaagcagcaccctcagcagccccaggtcatcacttcctacaacagccaagggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacgcctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttcctctacaatgagttctacttcctcacccaccctgcactgttcatcgaggaccacttcccagacaacaagaactggcagctgctaaaacctcctcaatctctgaggcagtttgagaacaacatgtatcacaagagtgaattctacaacaaagggatgctgagtgcccacccagagacttccatgatcagaacagtgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggcactcacaagctgcagatctttgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaaggaagtctatgtcatggtgctggagaatgccaaccacaatttctactcctacatcctgaaatacaaagtgaatgcccagtga

SEQ ID NO: 15548 - DNA, 2345 bp, Homo sapiens
atttgcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgaaaacttggtggagaagcagcaccctcagcagccccaggtcatcacttcctacaacagccaagggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacgcctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttcctctacaatgagttctacttcctcacccaccctgcactgttcatcgaggaccacttcccagacaacaagaactggcagctgctaaaacctcctcaatctctgaggcagtttgagaacaacatgtatcacaagagtgaattctacaacaaagggatgctgagtgcccacccagagacttccatgatcagaacagtgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggcactcacaagctgcagatctttgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaagatctttgtcaagaagaggcaggaaccaggaaactacatcttcgtctttaattaccttgtatgctgtgccaacaccaaggtgaactggcccatgttccctgagagctttggcaactggggacaggacaatgagctgctggaacctctgtcaggtgtgcttcctgccaaccggaatgtcccattcaaattgaagctgcatggtattgccaaagtcctggtgaaggggcaggacacatggcccctgaccctgaaccacgagggctactgggagggaagctgcagcacagctggctgccaggaagtctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccacaggagctgtgatctttgtgttctgaaggcttcactcaggtgtggctgtgactgagggggcagaggcagtggctctttagaaggaaaaggtgctatgtaaatctaaggtattgtaaactgtacacctgcatccagatgccccttctcgtatt

SEQ ID NO: 15549 - DNA, 3288 bp, Homo sapiens
cagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagactagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgaca

SEQ ID NO: 15550 - DNA, 2532 bp, Homo sapiens
gctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccgtctcttcttccccaggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgaca

SEQ ID NO: 15551 - DNA, 3218 bp, Homo sapiens
agagtggggcaccctgggactggaccccgcaggtgcttgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgactttta

SEQ ID NO: 15552 - DNA, 3044 bp, Homo sapiens
gctaggcgctgggcggccaccggctggccaggcaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatga

SEQ ID NO: 15553 - DNA, 4322 bp, Homo sapiens
cagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcgtgactggcaggggcattactcatggagtcagttggactgtggcagcccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactgata

SEQ ID NO: 15554 - DNA, 3157 bp, Homo sapiens
gcaggcgcgcggcgcccggctcggaccgtagctaggcgctgggcggccaccggctggccaggcaggcctgccaggatggaggggcatgctgggatggaggggcatgctgaaatggagatgctgaggacactgaaggggccttccacaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatga

SEQ ID NO: 15555 - DNA, 573 bp, Homo sapiens
gcaggcgcgcggcgcccggctcggaccgtagctaggcgctgggcggccaccggctggccaggcagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgtt

SEQ ID NO: 15556 - DNA, 460 bp, Homo sapiens
gctaggcgctgggcggccaccggctggccaggcaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggc

SEQ ID NO: 15557 - DNA, 3335 bp, Homo sapiens
agagtggggcaccctgggactggaccccgcaggtgcttgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgactttt

SEQ ID NO: 15558 - DNA, 865 bp, Homo sapiens
tgacttctgggtcaatgccaactcccctgacattcaccctgctggctggttcgagaagacgggccacaagctgcagcctcccaaagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctc

SEQ ID NO: 15559 - DNA, 3296 bp, Homo sapiens
gaatggcgggagcaggcacggaaccggcttttcctccttcctgcagcgtgattggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 15560 - DNA, 864 bp, Homo sapiens
gagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaaggtcggcagtgagcccttaactgatgtgcctccttccgctcttccatttttctgcatcctgcatgccactcactggagcat

SEQ ID NO: 15561 - DNA, 3888 bp, Homo sapiens
cgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatc

SEQ ID NO: 15562 - DNA, 5000 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 15563 - DNA, 4655 bp, Homo sapiens
catcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcc

SEQ ID NO: 15564 - DNA, 5027 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 15565 - DNA, 5113 bp, Homo sapiens
tcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 15566 - DNA, 655 bp, Homo sapiens
aagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaagg

SEQ ID NO: 15567 - DNA, 637 bp, Homo sapiens
gagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgt

SEQ ID NO: 15568 - DNA, 5021 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatcctttcctgggcacagggtggtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 15569 - DNA, 1537 bp, Homo sapiens
ccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataac

SEQ ID NO: 15570 - DNA, 5033 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatcctttcctgggcacagggtggtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 15571 - DNA, 1377 bp, Homo sapiens
ggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggcaggtggctgtgagaggaccgagctggctatggcagcaacccatgaaagtgagtgataacaacatttattgtttcctgtggcgttgctttgctttgctattgactggtagcgcttgtagctttaaataaattgaggaagtatgagagagtaaatggaagaaa

SEQ ID NO: 15572 - DNA, 3446 bp, Homo sapiens
agtttctcccacggccccatgtccgcatggcggtgaaggtcgaagacgcgcgacccaaagggccaggttttcagtcagcccagcgttggcgacgggcgagggcagaacacaaccaccaccctagtcccgcccggctcggggcctagcttctctactcacagcgtcggagggagggagggagggagcgagccagcgtccccgcgtctgcggcaccctggccggcccttcgccctccgacgcgcgcgcctattggccaccgcagcctctcccacatggggcgaaggcgcgccacttcattggcccccgcgtgaggggcggggctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttagtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtagttccagctcctcagtaggctgaggtgagaggatcacttgagcccaggaggtctaggctgcagtgagcttatgttcatgacactgcattccaggctggatgatagagcaagatcttgtctcaaaaaaaaaaaaaaaaaaaaaaaaaatccagcctgggcaacatagtgaatgaaaccccatctctacaaaaaatacaaaaattagctgggcatgatggtgtgtgcctgtagtcccagctacttgggggctgaggcaggaggatcgcttgagcccgggagatcaaggctacagtgagctgtgttcatgccactataccccagcctgggcaacaaagtgagtccctgactcaaaaaataaaaacaacaacaaaaaataaattccatgcttatttactttgcgaataaagaggcaaggtacagttttatctgtccgaatccctgacttttatttattttttttttcagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttacattcttttaattttgaagagtcacaaaactcacattatttagagcaacaatatttgtatttggaaattaaaaattcatgatttcaagaaaatacataaaatttacatttttgagtagtttgaataagtttctatcttaattataatatttgtaggaaataacaaaacaaactcaaagcctttattatttccagtctctttgtaactgatgtggtatggtatcatcatgaaatctaaacagtggtacactg

SEQ ID NO: 15573 - DNA, 1958 bp, Homo sapiens
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttaca

SEQ ID NO: 15574 - DNA, 6595 bp, Homo sapiens
gtgaccccaggccctggtcactccatgctttggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctgaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggaaaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaata

SEQ ID NO: 15575 - DNA, 2630 bp, Homo sapiens
ggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcg

SEQ ID NO: 15576 - DNA, 569 bp, Homo sapiens
acggccaccgcctgggccgcagcggttagtgggcaacggtgtggttcgggcctacctcgtcggcagagggtgggcgctggtttcagtgaaacgatccccaccgcatgctggtaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcc

SEQ ID NO: 15577 - DNA, 2128 bp, Homo sapiens
acgtggtgcctccccgcgcggggagcggcatgtgactgccgaccggcgctccgcgagtcctccctctccctcctccgcgttttggtccttttggaccgtgcccctttccggggggagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcg

SEQ ID NO: 15578 - DNA, 2157 bp, Homo sapiens
ggggcccggcgtggggaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatt

SEQ ID NO: 15579 - DNA, 2286 bp, Homo sapiens
aagccaaaaaccgccgctttcaaatcgccaatcaaattcttccttggcttcgagtctctcagccggccgcgctctccgatgcccagccctcctggaaccacctcgcctgtgacgtaggtggagcgcgcactgcctccgggcccgtctttctcaattgggaccggaaaacgttgtcgctcatcctatgacgcgaaagtaaccgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 15580 - DNA, 1047 bp, Homo sapiens
ggggcccggcgtggggaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagc

SEQ ID NO: 15581 - DNA, 753 bp, Homo sapiens
gatggagaggagggggtgttgcgatggagagtgtccacgtcccttaatcttacacttttcacttactgacttaaaagtgcagcttagtgagataaaggtgtaattttttatattattctaggataatctggccctgtgttttaaaaggtacaaagaaactaaagctatgatccctaacatagaaggtaaattatttttaaatttaatttattaaatataaaaatgaatgttctttctgtttgtcttctgatggccaaatgtgagtccattattctctcagacagttaaaggctaatctaaatatttaactatattagctattgtggtgatttaaatatttacatctttttcttgtaattcacaggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtg

SEQ ID NO: 15582 - DNA, 579 bp, Homo sapiens
gagactatcaggatccggagacggaaatgtccgaaggccgcagtacttgaccctgtattttgggagtcgaacggagactctgccatcgtcctcaaagagtaaaaaatccagttacggaagggaactaacacttgctagatatggtgtgcagagtgcgtttgcaaagaaacttaagagaaaacaaatgataggacacagggtggtggaagatctcaaagagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaa

SEQ ID NO: 15583 - DNA, 2332 bp, Homo sapiens
ggaaaacgttgtcgctcatcctatgacgcgaaagtaaccgagactatcaggatccggagacggaaatgtccgaaggccgcagtacttgaccctgtattttgggagtcgaacggagactctgccatcgtcctcaaagagtaaaaaatccagttacggaagggaactaacacttgctagatatggtgtgcagagtgcgtttgcaaagaaacttaagagaaaacaaatgataggacacagggtggtggaagatctcaaagagataatctggccctgtgttttaaaaggtacaaagaaactaaagctatgatccctaacatagaaggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 15584 - DNA, 551 bp, Homo sapiens
attccccagaccttctgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaatccatagtggagaaaagtatcttactaacagaacaagcccttgcaaaagcaggaaaaggaatgcacggaggcgtgccaggtggaaaacaattcatcgaaaatggaagtgaatttgcacaaaaattactgaagaaattcagtctattaaaaccatgggcatgagaagctgaaaagaatgggatcattggacttaaagccttaaatacccttgtagcccagagctattaaaacgaaagcatcca

SEQ ID NO: 15585 - DNA, 728 bp, Homo sapiens
atttcaggttcttgggggtagccaaaatgaggttctttgtccctctgttcctggtgggcatcctgttccctgccatcctggccaagcaattcacaaaatgtgagctgtcccagctgctgaaagacatagatggttatggaggcatcgctttgcctgaattgatctgtaccatgtttcacaccagtggttatgacacacaagccatagttgaaaacaatgaaagcacggaatatggactcttccagatcagtaataagctttggtgcaagagcagccaggtccctcagtcaaggaacatctgtgacatctcctgtgacaagttcctggatgatgacattactgatgacataatgtgtgccaagaagatcctggatattaaaggaattgactactggttggcccataaagccctctgcactgagaagctggaacagtggctttgtgagaagttgtgagtgtctgctgtccttggcacccctgcccactccacactcctggaatacctcttccctaatgccacctcagtttgtttctttctgttcccccaaagcttatctgtctctgagccttgggccctgtagtgacatcaccgaattcttgaagactattttccagggatgcctgagtggtgcactgagctctagacccttactcagtgccttcgatggcactttcactacagcacagatttcacctctgtcttgaataaaggtcccactttgaagtca

SEQ ID NO: 15586 - DNA, 1972 bp, Homo sapiens
cttccctccgccccgcgccgcggctggcagggtgtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaggaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataactgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 15587 - DNA, 2023 bp, Homo sapiens
gtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccatgagcatctgtaatttgctctttaaccattccttttttaggttttaactaatactttgtttacgtgttattagtttttaattgttttcatactgttttgaaataattttatacttatagaaaagttgcaagagtagtacaaaggattcacatatcctctttactcagattcccttaatgttagtttaccgcatttgcattacctttctgtctacatatgtgtttgtttctgaaccatttggaaataagttgtagacgtgatacccctttacctataaatatttacatgtgtattttctaaaaacaaggacattcagggccgggtgcagtggctcacgcctgtaatcccaacactttggaaggccgaggtgggtggatcacctgaggtcaggagttcaagaccagcctggccaatgtggtgaaatcaaccctctctctactaaaaatgcaaaaattagccaggtgtggtggcgggtgcctataatcccagccacgcgggaggctgaggcaggagaatcgcttgaacccaggaggtggagttgcagtaagccaagatcgtgcccctgcacttcaggctgggcgaaagagtgagactccatgtcaaaaaagga

SEQ ID NO: 15588 - DNA, 6279 bp, Homo sapiens
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggcggaaaactctctgttgtcctgcgagctgaagatatcccggagctcctgctagaaccacccatatctgcgcttgcccaggacacggtcgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagaatctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggcgttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgctgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccagatgctggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatgtttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttctccta

SEQ ID NO: 15589 - DNA, 3012 bp, Homo sapiens
aaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgctgaatgagccctttgtcattgcttaccagggctatggctacggaacagcagctccagttcatgggaggctggtttgcacatcctattttcaagaatggagattacaatga

SEQ ID NO: 15590 - DNA, 1303 bp, Homo sapiens
cttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtg

SEQ ID NO: 15591 - DNA, 744 bp, Homo sapiens
tggacgatctttacctcgaatatttgaatatattgccacgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataa

SEQ ID NO: 15592 - DNA, 1538 bp, Homo sapiens
tccgcacgactgttacagaggtctccagagccttctctctcctggtaggtttcggctcaggaccctgaatcctggcccacaggcaagcctgatgggacgtgcggggtagtacttgtatggggagacgcgggaaggaggaagaagcacatctgtcctccgcggcctttagctctgagcatccggccgcgggccctgactttgccgctcagtttggggcgcagggggggccgtgccctggcggaggagcagaaggcagagggtagcagctgcggctcagcggagagacttgttgcatttgcagctaaaaccaggccctacttgtccttgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtg

SEQ ID NO: 15593 - DNA, 732 bp, Homo sapiens
gcagagccggcgccggaggagacgcacgcagctgactttgtcttctccgcacgactgttacagaggtctccagagccttctctctcctggagccatgcgccagttctttcctgcagggcctcttttctggatgcttaggggcttcgtttactttaccagccttgggtgctccgagtaaggaagtcctagacttgtccccacagaccttactcggggagatctctagcttctgcatgccctcgtgatctgctgttctttgctgccggtgccctgaggaaaagatggtttgtgcgcaccgcgagcagtacaagctgcatgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggt

SEQ ID NO: 15594 - DNA, 487 bp, Homo sapiens
agaagccagagcagacagcaatttcgggacattgcagagctgtagtagatctgtactggtctgcagacagacaataatttgcactaagaccaggaagacgttctgtgaggaagacataggtggaaatacggaaagcagaaaagacaacttcggggtggccgggagataacagaagtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaa

SEQ ID NO: 15595 - DNA, 1256 bp, Homo sapiens
ggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctg

SEQ ID NO: 15596 - DNA, 2041 bp, Homo sapiens
gtgcgtgtctcgagtcgcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgaaagagtgaggctctgtctcaaaaaaaatcattataaatgcttatttttaagaccatatatatcaaaaagaaataaaaagctgagtgctgtggctcatggctgtaatcccagtgctttgggagggtgaggcaagaggatcacatgagtccaggagtttgagaccagccttggcaacatagcaacaccccatctctacaaaaataaagaaattagatgtggtggcctgcatctgtagtccagctacttgggagactgagaccagtagataacttgagcccaggagttcaaggctatgattgtgtcactgcactccagcctgggccacagaggaagactcagactcaaaagaagaagaagaacacagaagaaaagcagaaacaagaagaagatacagatgtaactttacgatgtaaaaaatctaaataagattgtattcaactctgcaagtattatactagtcatataaac

SEQ ID NO: 15597 - DNA, 2063 bp, Homo sapiens
ggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctaca

SEQ ID NO: 15598 - DNA, 1997 bp, Homo sapiens
ggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagct

SEQ ID NO: 15599 - DNA, 2978 bp, Homo sapiens
cagggcatgcagtttttgccttccggaactagatcaggatcatgcatttaagctagaaaatggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagcgcagactaccagaacctctgccatctccgatactgtgagtcaggccaaggtccaagtcaacaaggccttcctggactcccgaaccaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcc

SEQ ID NO: 15600 - DNA, 1897 bp, Homo sapiens
tgctttcctgtccagttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcc

SEQ ID NO: 15601 - DNA, 2729 bp, Homo sapiens
cagggcatgcagtttttgccttccggaactagatcaggatcatgcatttaagctagaaaatggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcc

SEQ ID NO: 15602 - DNA, 2350 bp, Homo sapiens
gctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctca

SEQ ID NO: 15603 - DNA, 2979 bp, Homo sapiens
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttataaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagagcaagcataggaattataactgaaatgtaggttcagttgctcatcacttgcagagtctaattaacaagagctaggtttggtataaag

SEQ ID NO: 15604 - DNA, 2494 bp, Homo sapiens
gtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttg

SEQ ID NO: 15605 - DNA, 1100 bp, Homo sapiens
agagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcag

SEQ ID NO: 15606 - DNA, 2119 bp, Homo sapiens
gtccctcccgggctggggttcccaccactctttcgggctccacatcccgggtcggagagaccgagaccttcgggccggtgcggtcattgcagctaggccggcgggaggcgggtgcgccaggagcgcggctcgcagtttggggtgggggcggtggcttttcagtcgcccgaggttcgggtgcaataaaggagcagctaatgtaatttacaaacagctcgggccgaacgcagcgcagcgcccggactgacaggcgcattaggcaggctaattccagccggctcctcctacccccggcccgctaattaatgagcttcccaacttacagccgcctgcattggacagacagagagtgaaagagagggcgagggagagggagagaaggagagagaaggggggagcagagaagagagaagagagagggagggagggagagcgagaacaggaggagagaacagaggcaaagaagagaggaaaaagggagaaaggagagagaaagagaaagaagtgccgctgcagataattgattacaccgcgatcaaggctaacttgttagcaatagtcaattgccccgtctctccgcctccctcgcagtccgggatcggcgccctcgcctcggctcttccaactgcggccgccaggacccggggccaggagccactgccgagccacctgacacctttaaatagcaccggggttggcgaaactggagccccgcgcagcgcgccccggctccggccccggattgctggaagccccagcagcagcggcgcccgcgtcagcgccctcttcccggggccccgcgctgttctcccctcctcagccgccgcgctaatcggccccgcgcccggcccgcgccctgcccagtgcggcctcctttccacccgccgctgcctgcccgcgccgtccggcgcccgagctgcccgcgggctgggtccccgcggcccgagccgccccggccgggaccccgaacaaggccgagatgacttccaaggaggacggcaaggcggcgccgggggaggagcggcggcgcagcccgctggaccacctgcctccgcctgccaactccaacaagccactgacgccgttcagcatcgaggacatcctcaacaagccgtctgtgcggagaagttactcgctgtgcggggcggcgcacctgctggccgccgcggacaagcacgcgcagggcggcttgcccctggcgggccgcgcgctgctctcgcagacctcgccgctgtgcgcgctggaggagctcgccagcaagacgtttaaggggctggaggtcagcgttctgcaggcagccgaaggccgcgacggtatgaccatctttgggcagcggcagacccctaagaagcggcgaaagtcgcgcacggccttcaccaaccaccagatctatgaattggaaaagcgctttctataccagaagtacctgtcccccgccgatcgcgaccaaatcgcgcagcagctgggcctcaccaacgcgcaagtcatcacctggttccagaatcggcgcgctaagctcaagcgggacctggaggagatgaaggccgacgtagagtccgccaagaaactgggccccagcgggcagatggacatcgtggcgctggccgaactcgagcagaactcggaggccacagccggcggtggcggcggctgcggcagggccaagtcgaggcccggctctccggtcctccccccaggcgccccgaaggccccgggcgctggcgccctgcagctctcgcctgcctctccgctcacggaccagccggccagcagccaggactgctcggaggacgaggaagacgaagagatcgacgtggacgattgagcggcgccccgggtcttccgccgccctgggctcctagcgctcgaaagcccaacgcctcccggaccggaccgccgaggggagctgggacctcctctgccaactcccgcctcctcccctgtccccggccccggactcggctcctggcagccgcctcttccctctcgaagcaataaacccaggctggccggccgggccggccgccaccagcggcctccgccgccccggaagccctcgccgtgcaattctgtatggcttctatataaatatttaaacctatatagcgggttcttccca

SEQ ID NO: 15607 - DNA, 1186 bp, Homo sapiens
gatccaccgcggcccggggtggagaggtgggggcgcaggaggaggggcacacgggactcgggcccagagccgggggcgggtccgaggctgggggcccggattgggagccgagcactggggcccaggcgtttgcggagcctagcgcaacggacagccggaccgccccagcccggccgaccatgaactcgggacgcgagccccgaacaccccggacactcttaagcatcgcagacatcctagccccgcgcatggtcccccgagcaccctctgcgccgcagcttccagagtcgggtccgggtccaacgtcgccgctgtgcgcgctggaggagctgactagtaaaactttccgcggacttgacgcgcgcgctctgcagccctctgaagggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgca

SEQ ID NO: 15608 - DNA, 3201 bp, Homo sapiens
gaaataaaaacttttaaaaagcacctctcttctgccttattcttcctgcctcacactcatgctgtgtcctgccttcttcaaaaatcctctgagtttcattgtgaagaagggcctgtcctctatggccatgggccctcaatgtcttgccaaaggagaagggtagaggatccctatatgtgtgaaaccaggcctcccacaccactctttttggtgatgggaaggtttcctggaggggagctctcagctgtctttgtatgctgcagcatacagtgcgggtgcgggcctcttaggaggtttcctaattcagcggtggtgagaaggctagagttggacagtggctgctgcaggattgaacaagtgtgattttttaaagaaaaatccaaagaattgcattatagttttataacttgggggatggggacaaaaaggagggagaagtctaaaaaacaaatggagtggggccacaggaattgtcagaaatggaggcttaggctgtccatacaggattcagcaagtacttggggactgcgactagaagaagccagggtggggaataagtagctgaggaggagagggagctgatgtggaggagagcaagggcaacttcaaggaacaaaagggaagctgcaaggcaccagctccattaattcagcaaacattccttgtctgtatgccatgccagggtccttgttctatggttctctcagtggggtagctagaaacttgcccaacagacaggaacagacagaagccaaagcaaagaattcctgaaggtagccggcctgctgccaaacctgggacaaactgtatggaggcgcagcgtgtgtagccagaacccgagttaaaacctaggtcccaccctggccggtctgactccacggcttctaggggttggttgtgcgaagctgttgagggctgaaggcgctaaccatcaaagatggaggtcgggtggcagaagatggggtgggaggcagagagtgagtacagcgaaggcggcctcaactggataagaaaactccagacttgcgggaaaggcctgagctcgcattggacgctctggggtgccacagtcggacactgtttccgggagacctccgcctctccgcgcggatgaagaggctgcagacgccgaagaagagctcgagtgcgtggggcactgatggggatcggggtgggcacacagcagacggcctgggtacgcttctttcctgacatggtctccaaggttagcaaagcttccaaacgtttccaggcctccagcctggaatgcctctccccccgctccccgacctcttccaggaacaccccagctcagggctccccactccccttcctgcgaattgaagctctgtgggctttgcggtccgggcgggcgagtacctggcggccggggctgttctccaggagtttctgcgcgaaaagtttcctaggagtgacgggatggcgtgggctcaggggagagtagaaacgctcccgggggctttgcagggaccgagcagctgcgggagctggggagcagtctgactgggactccctggaaggccctgccattggggctgggcggcagctcggcgtcgaaaaagccgggtctgaagattaatgtgccgaggccggagaccctgaggaccaagtcacgggacttgcccttggtgactcacgccttgaggccgagcagcgcggaaggcgctcaggccggatctggggtggggcccagccgagccttggtcttgtctgtcagcagcggcagctgcactgcgtctcccaaggtggctgaagctggccagctgcgggctccgcgccgctcgtcccgggtctatgggtccattccccacgcccacccggaccccggggtcactcgggtctccgtctgtgccagggagggagaatcacgcccagggtcctctctggcttcgcgcgactgagaacgcgcccggacgcggcgcggcgctcctgagtcaaaggagaggtggcggcaggaccaccccagggcgccgtctgcacccccggacgcactcggccgtgctgcgcttccgggacaaggcgtcggttctcgcctgagggccaaaccttgcccctgcccaccttcctcacccccgccatttccaggactcacatccaaaggcgacagcaccaggatttgctcccgcctttggcacagaggaggacgggtccctctctcagcctggccagtctttcccagggcttgatgggaaaaaggacttccctagaagtgagtcttggggagttggggggagaaaagtgtcgaggagggcgtcggagtttcccaccgctggctgcttcccggcccgcacgcccgggagggtggcggtgggcgcgcagagatctttgcaaaacagcgtccagggcggaaaacaactcacaggcctgccgcccccaaaggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgca

SEQ ID NO: 15609 - DNA, 1692 bp, Homo sapiens
gccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15610 - DNA, 3135 bp, Homo sapiens
aggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctg

SEQ ID NO: 15611 - DNA, 2069 bp, Homo sapiens
aggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15612 - DNA, 1679 bp, Homo sapiens
gtgtgctgcctggcaatggggaactctgagggctgatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15613 - DNA, 2253 bp, Homo sapiens
gagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaa

SEQ ID NO: 15614 - DNA, 3190 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggc

SEQ ID NO: 15615 - DNA, 2461 bp, Homo sapiens
attccttgacccgaggaggatagggatgtggccttcggtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagacttgatgtaattgtcttcacaattctgtgaagatggacttggtgtctctgcttcacatgaagggacctgaggttcagagaggctaagtaactttcctaggtcacagagctgtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15616 - DNA, 1577 bp, Homo sapiens
atgcagccactcctgtgcttggggaacctggaggatgcaagggaaaggactggcactctgctggcacagcacccggcctggggcaggacacgggcgaagccagggtctcccctcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15617 - DNA, 1683 bp, Homo sapiens
aagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 15618 - DNA, 1943 bp, Homo sapiens
gagaccctctgctcttctgctcccttcctgtgtgctgcctggcaatggggaactctgagggctgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagag

SEQ ID NO: 15619 - DNA, 3745 bp, Homo sapiens
gtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 15620 - DNA, 3774 bp, Homo sapiens
tgtgtttcggtgtgtaacgcataaaacttcttgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatc

SEQ ID NO: 15621 - DNA, 736 bp, Homo sapiens
gccgctgggggaggaagcccgaggccggcgcagcggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagcgcccgtctgacagatgagcaggcggccccgcggtcctgcagtaggaggctgacagggcgcggcggcctggcgggacggggaagggtctgcggccgaggtgggcttagattcgcgctgcttgtcactggctttgagggtcgtggtcgtcgcggtttggtgattctccaggcacactgcatggctgctcgctcctatgcgttgaattccttcgcccggacagtctcaaaaatcgggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaa

SEQ ID NO: 15622 - DNA, 478 bp, Homo sapiens
attggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaacgtgagtattaattttagtctcagtttaatttattaaatattatgtactgaggcttttatgccctgctgtctacatacttgaaacatgccattttgaatggcc

SEQ ID NO: 15623 - DNA, 874 bp, Homo sapiens
agcagaaaaaaaaaagcttaggatccgtaacagattcggagtcaacaatgacatgactcagcattttggggttcaattaaaaccaggcttgtaggttgcaggtcaagttgtgtttcggtgtgtaacgcataaaacttcttgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctg

SEQ ID NO: 15624 - DNA, 536 bp, Homo sapiens
tctcgacatcattaaaaatgtacttttatttttatatagatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagt

SEQ ID NO: 15625 - DNA, 2878 bp, Homo sapiens
ctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 15626 - DNA, 4671 bp, Homo sapiens
gccgcggcgggcggcgggcgcggcgcggcgcggcgccatcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 15627 - DNA, 4634 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttt

SEQ ID NO: 15628 - DNA, 1310 bp, Homo sapiens
agataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttatgagcaagtcgacctggacacctgctggctgtcagaaaggcctaagctggctcccgatgcagaggacaaagctcttgccagagccccgggcttttccagtaggagcggcttcctttactatcagtcaggtccagtcagcaaaggagggcctaggacagagggagttaaaatggggccttgctgtaaaggtgcctgcgaaagctggagctggagctggagctggagctgtgctaaaaatcagagcggggacagggagggaaagggtgcctcaagcaactcagatgacacggcccaatccatag

SEQ ID NO: 15629 - DNA, 9657 bp, Homo sapiens
cggggccagggcagcgcggactcgcgtcccgtggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggttggagtccgtctctctggacatagccagctctaatgccatcgacctggtggtggccgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctaaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 15630 - DNA, 9687 bp, Homo sapiens
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacacagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 15631 - DNA, 9690 bp, Homo sapiens
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagactattcaataggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 15632 - DNA, 9640 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattctaaataa

SEQ ID NO: 15633 - DNA, 3539 bp, Homo sapiens
aagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacacagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacagcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattc

SEQ ID NO: 15634 - DNA, 5175 bp, Homo sapiens
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 15635 - DNA, 10506 bp, Homo sapiens
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaa

SEQ ID NO: 15636 - DNA, 10335 bp, Homo sapiens
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtcctt

SEQ ID NO: 15637 - DNA, 10497 bp, Homo sapiens
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggtttaccaaggcaacaaacatccgctttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtggggcccatgccagcccaacgtcatcgggcggcagtgcacccgctgtgcaacaggcctacggattcccacgctgcaagcgtaagtcgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtcctt

SEQ ID NO: 15638 - DNA, 1826 bp, Homo sapiens
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaaggcaactggtgtgactgtaatctggaaggtgttctccctgaaatatgtgatgcccacggacggtgcctgtgccgccctggggttgagggccctcgatgtgatacctgccgctctggtttctactcattccctatttgccaaggacccagtgaaaaggtggccatctacaagccagaaagcaggccctcagcagaaactgaaccagccagcacctggatcttggacttcccagcctccagaactggagaaataaatttctattgtttaagccca

SEQ ID NO: 15639 - DNA, 5007 bp, Homo sapiens
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 15640 - DNA, 6547 bp, Homo sapiens
gaatattcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgaga

SEQ ID NO: 15641 - DNA, 541 bp, Homo sapiens
agtcccgaacggccagggagaggaggtggcctagcgctggcggggctcaccccaatccgtctgccttttgatgccgtactgtaagctccgtccatctgtaggttcttgagccagaacctctgcgggaaggagaaaaactgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattc

SEQ ID NO: 15642 - DNA, 1061 bp, Homo sapiens
gggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttgcatttggatgttgagagttgaaagttgaggcttcggaatgtgtctgctcaaaggggtgagagtgcatgtgttggtgctctgagttcatccgctagactctcaccggggactgcagcagcacatcggtgacttctgccacttgcgtgtcccagtagtcattttgtcaagccacggcacttaacgtgtgtgccctgtcactggcttcctgctcctctgtgctgttaggacagtgggaacactactgcaggatctttttgtctcatattagacaagaagtcttctgcagcagggaaggtgagggggtgagtgagagtggctggtcatgaaaggagctgttagacaactgctgagagggtatcttaagtagaaacgagccattgtattccagaaacaagatgtttccattaaaatcaagcctcagga

SEQ ID NO: 15643 - DNA, 776 bp, Homo sapiens
gcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaaggccttctccacagagcacgagaggctttccactgaatgactcg

SEQ ID NO: 15644 - DNA, 672 bp, Homo sapiens
tgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaa

SEQ ID NO: 15645 - DNA, 6297 bp, Homo sapiens
agaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaaca

SEQ ID NO: 15646 - DNA, 5983 bp, Homo sapiens
agtcccgaacggccagggagaggaggtggcctagcgctggcggggctcaccccaatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccgg

SEQ ID NO: 15647 - DNA, 1080 bp, Homo sapiens
aatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgactactgacggagaagacccaggtttttcagcttctgccctatcgttcattctcagctctcagggagccagagaagccagggctccaacatgaacacttcttgtagctcactgtcatgaccagtgtttcagtcagttcttgcaggttgcctgacttacctcatttctctcatttcctgtaagcaaccaaaaataaaaggctttcttttatttcattttgtcttattttgcttttatcttgaaggcatataagacctctgtatctgccttgttcaccttcaactgcttctaattcttcctcaattccagtgtccaatgtcaatttgaaattaaaatttacagactgattttaactaagctgttggtaaagctgacctaagccattcagccacaaaatatagagtatacaaaattatgctaccattttacacatatcaagcaagcaaagagatttttttttactggtggaacactaatctttcaaatatagaatagtggctaaatgaaaataaaacagcttagaaatcta

SEQ ID NO: 15648 - DNA, 645 bp, Homo sapiens
agaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttg

SEQ ID NO: 15649 - DNA, 1346 bp, Homo sapiens
agtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataa

SEQ ID NO: 15650 - DNA, 554 bp, Homo sapiens
gacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgt

SEQ ID NO: 15651 - DNA, 588 bp, Homo sapiens
aaaagctgaatattcttctggagcccttggaggggctccaaactgagaggggagggaagaccgcagggaaaggcggacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacagg

SEQ ID NO: 15652 - DNA, 1330 bp, Homo sapiens
aatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaata

SEQ ID NO: 15653 - DNA, 539 bp, Homo sapiens
gtctatcccccagaaaaaacccgagaaaccttgctcaagaaagtgggcaccctgaccctctgccttcagagatcatctacctttggttcctgccctggaatcccttttccacccactttcctgcaaactagcgggggccacataaaatatctatctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccct

SEQ ID NO: 15654 - DNA, 6438 bp, Homo sapiens
ttcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaa

SEQ ID NO: 15655 - DNA, 1284 bp, Homo sapiens
agcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaaaaaactaaacaaaaaaacaataaaaaataa

SEQ ID NO: 15656 - DNA, 11426 bp, Homo sapiens
agacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 15657 - DNA, 1674 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgacaaatacaaaaattagctgggtgtagtgatgtgtgcctgtagttcgagctactccggaggctgaggtggaaggattgcttgagcctggaaggccgaagctgcagtgagccatgatcacaccacagcactccagcctgggcaacagagtgagaccttgtttcaaaaaagaaaa

SEQ ID NO: 15658 - DNA, 1943 bp, Homo sapiens
ccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaatggagtttcactctgtcgtccaggctggagtgcagttgcacgatctcggctcacttcaacctctgcctcctgggttcaagcgattctcctgcctcagtctcccgagtagctgggattacaggcacctgccaccacgcctggccaattttttgtatttttagtagagacggggtttcaccatgttggccaggctggtcttgaactctgaccacaagtgatccacctgcctcggcctcccaaagtgctggtattacaggcatgagccaccacgcctggccagttttcttcctcatcttaagtcaggtttgattatttgtattagcaaattgtgtattttgtttggattttttaatgtattgacataaagttatgcacagtggcctgttataaagttaaaatttctgttcatttct

SEQ ID NO: 15659 - DNA, 5725 bp, Homo sapiens
ttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaag

SEQ ID NO: 15660 - DNA, 550 bp, Homo sapiens
ttctttgggctcgggggctcccggagcagggcgagagctcgcgtcgccgggtgaggagaacaaagtggctgcacgattttccccactttccagcccaccccccgcttccgtgggagcgacaggaaatggaagggcgcctcttctctctttgaacatttgccttttttcccctcctttccacctctccagaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctga

SEQ ID NO: 15661 - DNA, 2806 bp, Homo sapiens
ctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggca

SEQ ID NO: 15662 - DNA, 5643 bp, Homo sapiens
agggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaat

SEQ ID NO: 15663 - DNA, 1356 bp, Homo sapiens
atgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacagggtattgcccagggtgccatccggggggcagtggctgacacacgggacacagagcagcctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggc

SEQ ID NO: 15664 - DNA, 5674 bp, Homo sapiens
ccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 15665 - DNA, 4033 bp, Homo sapiens
ggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagc

SEQ ID NO: 15666 - DNA, 3931 bp, Homo sapiens
gcgggaggaggactgtatctctggatgcctggggcctggtttcagggcctgatttattcctcttcctgggagctcactcaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccac

SEQ ID NO: 15667 - DNA, 4305 bp, Homo sapiens
cttttctcctgcaaagggtccagccttttcctgctccccacgttgtccttacggctgtgtggggtagggcagggtccacactccttcccatccattttagaggaggaagctggagtctgggaagggatgggattttcccagggcaccctgtgagtcacatgccacttgagacaagggtctagagctccagcattttccaagctacaaatgtatctgctgctccaagtgtcctagatcaggaccctaggtaaagacttctgaaaaatacttgagtctagaaacagaaaagaaaaagggctagtgtgctctaggggtttgcactgttgtacccagtttgctttgctgtgtcctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgagg

SEQ ID NO: 15668 - DNA, 908 bp, Homo sapiens
ccctgagaaaagccagccctctctcttggggctggaactaggtcttggccctttctacagcttttctcctgcaaagggtccagccttttcctgctccccacgttgtccttacggctgtgtggggtagggcagggtccacactccttcccatccattttagaggaggaagctggagtctgggaagggatgggattttcccagggcaccctgtgagtcacatgccacttgagacaagggtctagagctccagcattttccaagctacaaatgtatctgctgctccaagtgtcctagatcaggaccctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaag

SEQ ID NO: 15669 - DNA, 710 bp, Homo sapiens
agggggcagcagctccttgggacaccacggtagaggggccactgtgggtgccttccacaagtgctgctcagctaggagaggcctcgtatctctggggaggttagtgggctcctacagtcaaatgcgtgttgtcttccagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccg

SEQ ID NO: 15670 - DNA, 7887 bp, Homo sapiens
gcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatattgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgcagaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatctgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggtggttaataaaatgcaacacttggcatttttatgttttaagaaaaacagtattttatttataataaaatctgaatatttgtaacccttta

SEQ ID NO: 15671 - DNA, 5147 bp, Homo sapiens
accaaccgaggcgccgggcagcgacccctgcagcggagacagagactgagcggcccggccccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttaga

SEQ ID NO: 15672 - DNA, 4313 bp, Homo sapiens
accacctgatcaaggaaaaggaaggcacagcggagcgcagagtgagaaccaccaaccgaggcgccgggcagcgacccctgcagcggagacagagactgagcggcccggccccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaaa

SEQ ID NO: 15673 - DNA, 4345 bp, Homo sapiens
agagtgagaaccaccaaccgaggcgccgggcagcgacccctgcagcggagacagagactgagcggcccggccccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttac

SEQ ID NO: 15674 - DNA, 1688 bp, Homo sapiens
ccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacggtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatga

SEQ ID NO: 15675 - DNA, 6133 bp, Homo sapiens
gccgccgccgcccgcccctccctccagcctccccgccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacggtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcaccccccacaatggagcccaaatggggtcctcctgagcccagaagacgaggaggagctcacagcaccagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagccgggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgagcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgcccccgtgtggatagtcactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagaccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactggg

SEQ ID NO: 15676 - DNA, 1647 bp, Homo sapiens
gagaagggcttcaggacgcgggaggcgcacttgcttcaagtcgcgggcgtgggaacggggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaa

SEQ ID NO: 15677 - DNA, 1270 bp, Homo sapiens
ctggcaggaactgggcggtaaaatagcccttctgttactgtccggggctgcggggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctga

SEQ ID NO: 15678 - DNA, 4503 bp, Homo sapiens
taaaatagcccttctgttactgtccggggctgcggggtgagaggccagggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 15679 - DNA, 4781 bp, Homo sapiens
actgtccggggctgcggggtgagaggccagggccgagaagggcttcaggacgcgggaggcgcacttgcttcaagtcgcgggcgtgggaacggggttgcaaaacggggcctctttgtccgggtgggttaagggccctggcagctttttcgcgaaggcgccatgtcctagcagttgggccgcagtgggcccgaggtccactcggaccgccgagacggctcgatggccctggagctggaggaagggggatacctgggcgccgccgccgccctcgcaactcggccgaggcccctatctcaacctagtttctgtttttcccctgttctgcaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 15680 - DNA, 808 bp, Homo sapiens
agagtttgggatggcagcctcagaaggacaaacttaggccaaggagggagggagttggggtggagactgagcttctccagttggaggtctggagctaggactcttcattgaaaccggagagaaggaaaaggagagagtgaggctgactttttaactgaactccaaaattctctgagcaatagaatgggcctaatatgtaccaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaaga

SEQ ID NO: 15681 - DNA, 4602 bp, Homo sapiens
aactgggcggtaaaatagcccttctgttactgtccggggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 15682 - DNA, 4353 bp, Homo sapiens
gggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccaccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcccgtttggattttacactcaccttcgtgttttaaagaagcctcagagtgcattgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagtacatctcattcatttcttagatttgtattcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgacctatggaa

SEQ ID NO: 15683 - DNA, 2690 bp, Homo sapiens
gggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccatggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaaga

SEQ ID NO: 15684 - DNA, 4255 bp, Homo sapiens
gggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaa

SEQ ID NO: 15685 - DNA, 4390 bp, Homo sapiens
aggggcggggctgggcggcaggtcccgggtgcggacatctggcagctggcagtgggcggcgtagagcactgcagcagcaatgacggagggcacgtgagtcccctcgccccgggctcctgacgaatgcggggtggtcctaggtgctgaggagagcgcgactggggcagtgggccggcggccggcgttggggcggggcctgggtcgctgatggccggtggtcctcaggtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaag

SEQ ID NO: 15686 - DNA, 2523 bp, Homo sapiens
agctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctagga

SEQ ID NO: 15687 - DNA, 3572 bp, Homo sapiens
tctcgccggacgctaaagaccgacgcacaaattaagaatggaccattcttttaactcagtcatttatccaaactcgagacattcgccaggaaatctatcgaaaatttcccagaaccattttttcacttatattctataatactggtaaaatcgagacgtaaaaggagaacttgagaacaagtcattctgctttcccctctcaagtttgagcctgaactacttgggctcgcttatcgtcacttccggggatcgaactgtgaatcccggaaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaaccaagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaaccgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactgttgatgtggtttggatctgtgtcctcaccgagtctcatgttgaaatgtaagccccctggtgggaggcgatgggattatggggcagagtcctcacgaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaatta

SEQ ID NO: 15688 - DNA, 625 bp, Homo sapiens
atgtcctgccagcagagccagcagcagtgccagccccctcccaagtgcacccccaagtgccctcccaagtgccccactcctaagtgccccccaaagtgtccccctaagtgccctccagtctcttcctgctgcagtgtcagctccggaggctgctgtggctccagctctgggggcggctgcagctctgggggaggtggctgctgcctgagccaccacaggcgccacaggtcccaccgtcacagactccagagctctggctgctgcagccagccctcgggaggctccagctgctgtggaggggacagcggccagcactctggaggctgctgctgaagcggactctgcacctagaagagcagactcgggtgaaatgagtgatcaaacatttcctcctcacctgtctcctcctgggcctgcaagagtggctgagatgcccgcgtgaaggctctgagctctggcctagaggatccctctgccctgggatccagaaacttgattcttctcccacaaacctatctgctgcccctgacaccaactgtgttgtctactctgggatcccaagccacaaactcactctccagctcatttcctgcagcctcaagtgaaacaataaagcaaaagatct

SEQ ID NO: 15689 - DNA, 770 bp, Homo sapiens
gctgaaggaccctgtgctgcctgtgacctcgctcctgaacacccaccgccgagatgtcctgccagcagagccagcagcagtgccagccccctcccaagtgcacccccaagtgccctcccaagtgccccactcctaagtgccccccaaagtgtccccctaagtgccctccagtctcttcctgctgcagtgtcagctccggaggctgctgtggctccagctctgggggcggctgcagctctgggggaggtggctgctgcctgagccaccacaggcgccacaggtcccaccgtcacagactccagagctctggctgctgcagccagccctcgggaggctccagctgctgtggaggggacagcggccagcactctggaggctgctgctgaagcggactctgcacctagaagagcagactcgggtgaaatgagtgatcaaacatttcctcctcacctgtctcctcctgggcctgcaagagtggctgagatgcccgcgtgaaggctctgagctctggcctagaggatccctctgccctgggatccagaaacttgattcttctcccacaaacctatctgctgcccctgacaccaactgtgttgtctactctgggatcccaagccacaaactcactctccagctcatttcctgcagcctcaagtgaaacaataaagcaaaagatcttcttgccacttattgtggactgttccttgcctgtttgtgtctccaatatttttttcactgctctctactttcctgctgcctggaagctttgg

SEQ ID NO: 15690 - DNA, 1139 bp, Homo sapiens
gttctgaacttctatgtccttacaacaaggtaatctagaaaattcttccaagagagaatgactgtttccccttgagaaacaattttatttccaaacccctttctagattgttttcatgattcaggtgtgtagttgaagcagaatgtctcctctacatactacatgcttgattttgagaatactttcttaatatcttttggcttcggttttctaattataaaatagttgaaaatgctttatgattttataagtatataaaaagcattaggttcaaaacagaggctataagtgtgtttagccaactattagacacaatgaaacttcccgtgattaattagctacaactacactaagcagttcatcaaaatgtagggattagaaatgatgctgaaagggcaagaataggccggggtggcctctacctgggtctaacttgctgtctgactctctctcagctcctgaacacccgcaccaagatgtcctgccagcagaaccagcagcagtgccagccccctcccaagtgcatccccaagtgccctcccaagtgcctcacccctagatgccccccaaagtgtccccctaagtgtcctccagtctcttcctgctgcagtgtcagctccggaggctgctgtggctccagctctgggggaagctgtggctccagctctgggggttgctgcagttctgggggaggtggctgctgcctgagccaccacaggcgccgtaggtcccactgccacagaccccagagctctggctgctgcagccagccctccgggggctccagctgctgtggaggagggagtggccagcactctggaggctgctgctaaagtggatcctgagcctagaagaacacaaatggccaaatatttcccttccgtcttccttctccttctgggcctgcccatgttgttgagaggtcttggtgagggctcaactcaagcatagaggattcttctgtcttggagttcagaggcccaaaacttctcccccaaagccaagccatttaatgacctcagtttgcgtatgtgtggttgctctgggaagcccaaagcacagacctatatccctttgcagcttgtctttttgcatagctcagcctgatgtgaaacaataaaaccagaaatatgcattcc

SEQ ID NO: 15691 - DNA, 333 bp, Homo sapiens
atgtcctgccagcagaaccagcagcagtgccagccccctcccaagtgcatccccaagtgccctcccaagtgcctcacccctagatgccccccaaagtgtccccctaagtgtcctccagtctcttcctgctgcagtgtcagctccggaggctgctgtggctccagctctgggggttgctgcagttctgggggaggtggctgctgcctgagccaccacaggcgccgtaggtcccactgccacagaccccagagctctggctgctgcagccagccctccgggggctccagctgctgtggaggagggagtggccagcactctggaggctgctgctaa

SEQ ID NO: 15692 - DNA, 695 bp, Homo sapiens
gctgaaggaccctgtgctgcctgtgaccccgctcctgaatccgccaccaagatgtcctgccagcagagccagcagcagtgccagccccctcccaagtgcacccccaagtgccctcccaagtgccccaccccaaagtgtcccccaaagtgtccccctaagtgccctcctgtctcttcctgctgcagtgtcagctccggaggctgctgtggctccagctctgggggcagctgtggctccagctctgggggatgctgcagttctgggggaggtggctgctgcctgagccaccacaggcgccgtaggtcccactgccacagaccccagagctctggctgctgcagccagccctcggggggctccagctgctgtggcggggggagtggccagcactctggaggctgctgctgaagtggaccctgagcctagaagagcagaatccaggaccgcaaactgccaaggacatcccccttctcctactaggcctgcctgagaggctcacaggtccaagggaaagctctgaacttgccaagagcatatcttttccctggagtccagaaactcagatcctctcctggatctccattcactggccttggacctcacctttgtggctaccctcccacgctctgtctaagcccctagcttactcaatgtcatttgcagcgtgcatctgctgattaaaggactaaaacaag

SEQ ID NO: 15693 - DNA, 1179 bp, Homo sapiens
gctaaagaaccctgtgctgcctgtgactccgctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctactgtattctgtgctgcctgaactgaagaaataaaatccagaatctgctccccaatttgctaccagcctgcttgattttcctgtttgtgtcatccttgttctgctcccctgtgtctgctggtggctgctgaggccttggtggacagaggatggggaaggggtcaggaggaaaaagcttgcatttctgtgtgttttgtgttttttcttctttctgtgttttccttttaaaccaagggactgaaatagcattgagaaatatttttctttcaaattctggttcctttcacctatgtaaccgcatccctcaggcatggccaggaggccgacttcatcctccttctcactgtcacctcttcactcttgtgttcctcgttccccactccttccactaacaatctccccggactcctccttcagattgtatgtacacgtagtagacatataaatatatgtgtgtgtacatgtatatatatacacacatatttatatatactcacattatatggaataaatctttagtttttaaacttaaatcacttttattgatctataactttcacacaataaaa

SEQ ID NO: 15694 - DNA, 1180 bp, Homo sapiens
gccgaaggaccctgtgctgcctgtgactttgctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctgctgtattctgtgctgcctgaactgaagaaataaaatccagaatctgccccccaacttgctaccagcctgcttgattttcctgtttgtgtcatccttgttctgctcccctgtgtctgctggtggctgctgaggccttggtggacagaggatggggaaaggggtcaggaggaaaaagcttgcatttctgtgtgttttgtgttttttcttctttcggtgttttccttttaaaccaagggactgaaatagcattgagaaatatttttctttcaaattctggttcctttcacctatgtaaccgcatccctcaggcatggccaggaggccgacttcatcctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaattaaa

SEQ ID NO: 15695 - DNA, 575 bp, Homo sapiens
gaaacccaggctgggataaaagggctcagggccagagcaccccattcactcacttcctgaggtgccgaaggaccctgtgctgcctgtgactttggtatgtgtcctctgggaacagaagcaggggattccacagagggatgctcagatcagctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctg

SEQ ID NO: 15696 - DNA, 598 bp, Homo sapiens
atgtcttgccagcagagccagcagcagtgccagccccctcccaagtgcactcccaagtgccctcccaagtgccccacaccgaagtgccccccaaagtgtccccctaagtgccctcctgtctcttcctgctgcagcgtcagctccggaggctgctgtggctccagctctgggggctgctgcagctctgggggtggtggctgctgcagctctgggggaggcggctgttgcctgagccaccacagacggcgtaggtcccaccgccacagaccccagagctctgactgctgcagccagccctcagcgggctccagctgctgcggagggggcagtggccagcactctggaggctgctgctgaagtggaccctgtgcctaaaagagcagatttagaggcatgaaaggggcaacttcatcttccttgggactgactgtgttgctgggacattttagtaaagatttcaaactctgtcctggaagattcctccgacctagaatccagaaatctgccctctcacaagaattcctcttctgacctctgattccatctgtgcgcctggcctgggaataccaaatagaagtccttgcctcattcccctgat

SEQ ID NO: 15697 - DNA, 592 bp, Homo sapiens
ggacgtgtctgtgctcctgtgtgtgaccagggttgaaaaagtcgcactgagatgtcctgccagcaaaaccagcagcagtgccagccccctcccaagtgccccccaaaatgcccacccaagtgtcctccaaagtgccgacctcagtgcccagccccatgcccacctccagtctcttcctgctgtggtcccagctctgggggctgctgcggctccagctctgggggctgctgcagctctgggggtggcggctgctgcctgagccaccacaggccccgtctcttccaccggcaccggcaccagagccccgattgttgtgagtgtgaaccttctgggggctctggctgctgccacagctctggggactgctgctgaccagacctcgaacatcacagagcaacccttatggagaaacttgcaaccaggacctgtcccagagtgatgcttctcctgcccctttttctcctttccttgggctgacacaccttgtgaggtgttttgtctgttgtcatggcccaagagcccatcctggatcctgatcttaccttcccactttacctcatacaacaataaagctcttttgcctcttcgtgaa

SEQ ID NO: 15698 - DNA, 612 bp, Homo sapiens
cagggacgtgtctgtgctcctgcgtgtgaccagggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggagcacctcaattgcaggttttgttttcctcctttacctcatgttataataaagctctgatttctgactcacaaa

SEQ ID NO: 15699 - DNA, 607 bp, Homo sapiens
cagggacgtgtctgtgctcctgcgtgtgaccagggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggagcacctcaattgcaggttttgttttcctcctttacctcatgttataataaagctctgatttctgactc

SEQ ID NO: 15700 - DNA, 614 bp, Homo sapiens
cagggacgtgtctgtgctcctgcgtgtgaccagggttgactaaactcctgccagcatgtcttgccagcaaaaccagcagcagtgccagccccctcccaagtgtcctcccaagtgtaccccaaaatgtccacctaagtgtccccccaaatgcccaccacagtgcccagctccatgtttccctgcagtctcttcttgctgtggtcccagctctgggagctgctgtggtcccagctctgggggctgctgcagctctggggctggtggctgctccctgagccaccacaggccccgtctcttccaccggcgccggcaccagagccccgactgctgtgagagtgaaccttctgggggctctggctgctgccacagctctgggggctgctgctgacctgggctacagaagagctcttgggactgaatggccaagaacctgctacggcctgatggatactctttccacttcctctcattccattcattggttggcagagaccacaaagactcatggggctttcctggaagaacttcgtgcttgatgtaacaccccaattgcaagtcttcttttcctcctttacctcatgttataataaagctctgatctctgactcactaaa

SEQ ID NO: 15701 - DNA, 609 bp, Homo sapiens
cagggacgtgtctgtgcttttgcatgtgaccagggttgactaaactcctgccaggatgtcttgccagcaaaaccagcagcagtgccagccccctcccaaatgtcctcccaagtgtaccccaaaatgtccacctaagtgtccccccaaatgcccaccacagtgcccagctccatgttcccctgcagtctcttcctgctgtggtcccagctctgggagctgctgtggtcccagctctgggggctgctgcagctctgggggtggtggctgctgcctgagccaccacaggccccgtctcttccaccggcgccggcaccagagccccgattgctgtgagagtgaaccttctggggcctctggctgctgccacagctctgggggctgctgctgacctgggctgcagaagagctctggtactgaatggtcaaaaacctgctacagcctgatgcttaactatttccccttcctttcattccactcatgggtggacagggaccacaaagactcatggggcttccccagaactttgtgcttgatggagcaccccagatggaagccttctttttctcctttacctcatattgtaataaagctctgatttctgactcttta

SEQ ID NO: 15702 - DNA, 270 bp, Homo sapiens
atgtcctgccagcagaaccagcagcagtgccagcctccgcccaagtgccctgcaaagagcccagcacagtgtctgcctccagcttcctccagctgtgccccaagctctgggggctgtgggcccagctccgagcgcagctgctgcctgagtcaccacagatgccgcaggtctcaccgttgccgttgccagagctccaactcctgtgacaggggaagtggtcagcaaggcgggagctccagctgtggccacagttctgcgggctgctgctga

SEQ ID NO: 15703 - DNA, 288 bp, Homo sapiens
atgtcctgccagcagaaccagcagcagtgccagcctctgcccaagtgcccctcacccaagtgccccccaaagagctcagcacagtgtctgcctccagcctcctcctgctgtgctccaagacctgggtgctgtggtggccccagctctgagggcggctgctgcctgagccaccacaggtgctgcaggtcccaccgatgccggcgccagagctccaactcctgtgacagaggcagtggtcagcaagatggtgcctccgactgtggctatggctctggaggctgctgctga

SEQ ID NO: 15704 - DNA, 425 bp, Homo sapiens
ggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctcc

SEQ ID NO: 15705 - DNA, 613 bp, Homo sapiens
ctcaggaacagccttctcctgcctcctctgcacctggacaactcaactcctgccaagatgtcctgccagcagaaccagcagcagtgccaacccccacccaagtgtccctcacccaagtgtcccccaaagagcccagtacagtgtctgcctccagcttcctctggctgtgccccaagctctgggggctgtggccctagctccgagggcggctgcttcctgaaccaccacaggcgccaccaccgatgccggcgccagaggcccaactcctgtgacaggggcagtggtcagcaaggcgggggctctggctgcggccatggctctggaggctgctgctgacctggatcctgatgctgagacaagcgattttggaggaaacaagaatcccaagggcccaggaaaaccccatcttgatgcatgagttcccagataccctcttctggctttcacaggctgagctaggggttttcctgtggaaggtctgagctctccccagaaggcacttcctgtctgatgtccaggatgtcacatgttcccttacccctgtacctgtgaaggattggcagtgcttgtgcctgacctcatcaaaaaataaagctccttgtcctcattacca

SEQ ID NO: 15706 - DNA, 611 bp, Homo sapiens
ctcaggaacagccttctcctgcctctctgcacctggacatctcaactcctgccaagatgtcctgccagcagaaccagaagcagtgccaacccccacccaagtgcccctcacccaagtgtcccccaaagaacccagtacagtgtctgcctccagcttcctctggctgtgccccaagctctgggggctgtggccctagctccgagggcggctgcttcctgaaccaccacaggcgccaccaccgatgccggcgccagaggtccaactcctgtgacaggggcagtggtcagcaaggcgggggctctggctgctgccacggttctgggggctgctgctgatccagatcctgatgctgagacaagcgatctttggaggaaacaagaatcccaagaggccaagaacagccccatctgacgcatgccttcccatataccctcttctgactttcacaggctgagctggaggttttcctgtgggggatctgagctctccccagaaggcacttcttgttttatgtacaggatgtcatatgtccccctacccctgtacctgccaaggattggcagtgcttgtgcccaacctcgtaaaaaagataaagttccttgtcctcatta

SEQ ID NO: 15707 - DNA, 388 bp, Homo sapiens
tcattcaggtttatcgaaattccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgttgctgacctggaccaggagcagcaccaaaggaattagtgggcgaaggacccattgcagcctggtg

SEQ ID NO: 15708 - DNA, 672 bp, Homo sapiens
tgccgaagaggctatctgggaagctcatcatccagctcaggaagagatgaaaccaggaggcaggagaatgtcaggcatgaccccacacttgtgcaacagccacgtcctgctcctgccattagcatggctcatccgaggcccagccccaggatccatacaaagtgtgttcctgctgctggcttctcatctgctctgcttcctaagggacgtatctgttgctgcgtctgaacccacggtttatcgaaattccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgttgctgacctggaccaggagcagcaccaaaggaattagtgggcgaaggacccattgcagcctggtgttttacctccttcactctcttgcctttcctttctgtagccccatcaattgaataaac

SEQ ID NO: 15709 - DNA, 819 bp, Homo sapiens
caggtagagtgcttctcaggaccaggatgaactcttggtgctggtgttttgggcagaaagagcccctgggtggaggttgaggccattcttgaagaaagacaaggataaagaaggattttggaggggaaggttcttctggaaggggagggtggaagctttattcagcttctacagagatgtcctgccagcagagccagcagcagtgccagcctcctcccaaatgtacccctaaatgccctcccaagtgtactcctaagtgtcctcccaagtgtcccccaaaatgccctccccagtgttcagccccatgcccacctccagtctcttcctgctgtggttccagctctgggggctgctgcagctctgagggtggtggctgctgcctgagccaccacaggccccgccagtccctccgacgccgacctcagagttccagctgctgtggcagtggcagtggccagcagtctgggggctccagctgctgccacagctctgggggctctggctgctgccacagctctggaggctgctgctgacctgggccatgaggagcacggaggagaaggactggcagatcccaggtgctgaagatgtgtgtcagcctgaggcttcttttctctcatttcccatggaaggacttcggaaatgccttaagttcccctctttatcctgcccatgttcactccattgtagggttgaagtctagcttgtgatattttctggcctggctttccctctcagacatagctctttggagaactaggtgttgtaattcagttatgaagctattttctctgtaacaataaagctttttattcctga

SEQ ID NO: 15710 - DNA, 523 bp, Homo sapiens
ggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccacctccctgccctcccccagagtgaggcactgtgggcactacccaaccccaccaccactgccacctccaccatgtacaacgctgtggggctggagactgaaaccatgaactgacaagtaaacgtgttcctctgctgtgcaa

SEQ ID NO: 15711 - DNA, 2211 bp, Homo sapiens
attttgtgaaagcaacgcagagcacctaggcagtgccatttccttggctcttctcagtatgtgcagggaacacacccgtgtgcacactcacagatacgtgtttgccacattttagtacaactccgtttctgcattccactatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaa

SEQ ID NO: 15712 - DNA, 6153 bp, Homo sapiens
ggtcgcgcccgctggggcccgcgatggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcagggggtcaatgtctgtggagggcggtgctgtcatggctggagtaaggcccctggctcccagaggtgcaccaaacctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcaagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagctgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccaggtatagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggct

SEQ ID NO: 15713 - DNA, 5293 bp, Homo sapiens
gagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccaggtatagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggct

SEQ ID NO: 15714 - DNA, 6333 bp, Homo sapiens
cgctcgctctcggccaccctcgccgggccccgctgcggcgcgcgctgcaacccccggccggacgcgcggaccctcaccttgcgcggcccgctcccctcgcccctccccgctccccgggctccgcgctccccacccccacgccctcctcctgctcccagccacaatcggccggggtctggggccgctcagctgcccgcagagcctcctccctcgccaccgacttggtctcctcccgcctttcccgggctctcggcagctctcgggggagcccgaacgcgcggggaaaggcgagccgcacggccgggggagggggccggaccgcgcgcgaccggtcgcgcccgctggggcccgcgatggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcagggggtcaatgtctgtggagggcggtgctgtcatggctggagtaaggcccctggctcccagaggtgcaccaaacctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcaagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagctgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaa

SEQ ID NO: 15715 - DNA, 5087 bp, Homo sapiens
cgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaa

SEQ ID NO: 15716 - DNA, 5164 bp, Homo sapiens
gagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggct

SEQ ID NO: 15717 - DNA, 5092 bp, Homo sapiens
ctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaa

SEQ ID NO: 15718 - DNA, 8567 bp, Homo sapiens
cctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaa

SEQ ID NO: 15719 - DNA, 4443 bp, Homo sapiens
cttgctccggcctcctcgctcctgcctgagttcggggcctggtctgggcttcgtcctggggctgggaagtttctgcgctccccgctgtccagtctgcatctccgcgcctcccgccgggcccccgcggtcccctcccgcccgcttcccccgctgccctccctcgctgccccctaccctctcccggggctcccggccctctactcccttcgggcgcgggcccctcgccccgcccgggcgcgccccccctcccccgggtcctgcggccccggatgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttta

SEQ ID NO: 15720 - DNA, 3730 bp, Homo sapiens
cccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtgccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaagcaaattgatgttcacgtctgacgtgggcgcgggctgcgcagggcggcgccagaccccagccgcctcccaggggctagactgagcccggcacaaggggtgtgaaatagaatttattgtggctctgattatgtacacgtgagatggcctggctgggccggccgggctcacatggtttgtacaataaatacatctgtggggcgggctctccgcagccgggaagggccaccgccacggttcagtcc

SEQ ID NO: 15721 - DNA, 4046 bp, Homo sapiens
atgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcg

SEQ ID NO: 15722 - DNA, 2461 bp, Homo sapiens
gtgaagggcctgggttgagtaggggactcaggagaacagtggcggtttggaagtatcccagggcatggggctgcctaggggctttatggaagtcaaagctttagaggagtcagagagggaggtgccagccacacgaggctctgttggactgaggctgaagcctgtgggtatgttccagcatgctcagcttggtggctgctccagtcccactccgcacccaggatccacaggccacagctctgaccagagactgggcattgccagacagtgaggaggaaggagaggtgtttatggatcagggacgggagtcctagggatgataagccctgggctccagctgggaactatcagagtctgggggtgtcaggcaagctcggaggactgagagggaggccaccaagccctgtgagagagaaggtggaggtgaggacttgagaacagtggaaagaaggcagcctctgagggccccagggtggagcagatctgagtgatgaaaatccccttgggaccctgagagtgaggggaaggtcacggaagccgagagatccaggaatgtgaggtcagaggctgacctggttgtccacgcggatgttcgaaactcccaggatggagagaaaaacagagcaggaggaatgaggaagatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttt

SEQ ID NO: 15723 - DNA, 3756 bp, Homo sapiens
ttctttctgctcctcttctggaccccacagacttcctcctgggacctccgtgagccctggccaaaggctgtccccaccctttagccctttcctcagaggggattggaccagcactaacgagaagttactttggggccctgagacccccacgtttgcaagggaggctgggaaagagctggaaggcctgggctccggctccacccggcctccatcgtcagtgtgacccggcagggccacctctctccctcagcctcggtatctcgctctacgcaggcctccccgccccgccccgcccggaggaatccgcggccggccagacggtcccagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtgg

SEQ ID NO: 15724 - DNA, 3327 bp, Homo sapiens
gagctcctagggttagggctcaggtgggagatggctgttcttgggggctttgggaatgtggacaaggcccctcaaaggaggggctgttaaggaagcctaaggagaggtactccaggcaaagagaacagcctgcaaagcccactggccaggtgagtttggggcagagcagagttcactgttatggcccaggctgcatggcaggagtgagggggaaggggtgtgggaaatgaaactggtgagcagtgaggatccaaaggaggggagaggctggaggcagggagtcctgggcttggtgacaaagagagtgaggggggtggttcctggatctgactgcctgtgcacagctttggcactagttaggattcccaggaaaccagctcctgctagtcttgggagggggtaatcaacccttctggaatagggggtcgggtccctggggcaagggcttatggagtcactgggctagaggacactggtgtgaccgaggctatagagtttaaggtattgaggcgactggggagaaaggagttttagtcccttgggtgggagtactgggacgactgaggggccctgaggggatgtggtttggtttgaggtgagtggggtcagggtcttggagtgaaccgggaatggaagtatccgggcctgggtgtggggtgatacggctgtcaggggcctggagtcctagtttggagctttctggggtcttgatattggggttatctaaaagagagaaataggacatcctggagttggagtatgggcgtacaggaacctgaggtcatggtgtgactggggtgttgaggtctgccctggggatatggcagaaggtgagcgctccctgctctgccgcttgacctggccatgcccgcagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttt

SEQ ID NO: 15725 - DNA, 2750 bp, Homo sapiens
ctttgcgccggtgatctgcaagcggacctgtctcaagggccagtgtcgggacagttgtcagcagggctccaacatgacgctcatcggagagaacggccacagcacagacacgctcacgggctccggcttccgcgtggcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagac

SEQ ID NO: 15726 - DNA, 5031 bp, Homo sapiens
atgggagacgtaaaagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagtacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 15727 - DNA, 2569 bp, Homo sapiens
agaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagtacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttct

SEQ ID NO: 15728 - DNA, 5142 bp, Homo sapiens
atgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagtacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 15729 - DNA, 1700 bp, Homo sapiens
gtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcc

SEQ ID NO: 15730 - DNA, 4958 bp, Homo sapiens
agcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagtacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 15731 - DNA, 4776 bp, Homo sapiens
atgggagacgtaaaagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 15732 - DNA, 1285 bp, Homo sapiens
aactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgagtgtgcccgaagccccccaccctgcacctacggccggtgtgagaacacagaaggcagcttccagtgtgtctgccccatgggcttccaacccaacactgctggctccgaatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctag

SEQ ID NO: 15733 - DNA, 1116 bp, Homo sapiens
agaagcagtcagcccagggctctcggatgcagggagcctgggcccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctca

SEQ ID NO: 15734 - DNA, 1178 bp, Homo sapiens
agccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcg

SEQ ID NO: 15735 - DNA, 451 bp, Homo sapiens
aggccagggtgcccgccaggctgcctgacacccacagatgggtggagctcagtgctgctccagcgggcgagacgggcgggagaggactgtggcccaccacgtggggcactcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtc

SEQ ID NO: 15736 - DNA, 4542 bp, Homo sapiens
accctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgca

SEQ ID NO: 15737 - DNA, 4719 bp, Homo sapiens
agtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggaggtgggctttgaagtgggcgtggagacggcgggggaggtggaggtgcgagtataaatgatcaaccagaaattatcttcaaaggaataaaaccagaagtatgtaaataaaaagcccaagataaagaaacagaaaagctgacactacatgaagcagagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgca

SEQ ID NO: 15738 - DNA, 4928 bp, Homo sapiens
taaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagttttaaccaacctagatctgtcagctaagctaattttatatttggtatacatgcatgtcaaataaagttaattttacatac

SEQ ID NO: 15739 - DNA, 546 bp, Homo sapiens
tctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggacctgggctatgctcctgattttatacagactgccatggctccagatataaaagaccaaataaaaagataagaattgctggcaacatatgcactaaacttcgttttgaaaaatccccttgatgccgatcactgagaagtgatccacaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgt

SEQ ID NO: 15740 - DNA, 2654 bp, Homo sapiens
acagaatgtagccacctttcttaacggtccgggaaaccagaggtctctccagctactcagggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattc

SEQ ID NO: 15741 - DNA, 560 bp, Homo sapiens
ttaaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaccag

SEQ ID NO: 15742 - DNA, 1667 bp, Homo sapiens
acaaaccctcgttggccccacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 15743 - DNA, 1425 bp, Homo sapiens
tccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacagtaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 15744 - DNA, 1618 bp, Homo sapiens
cacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaa

SEQ ID NO: 15745 - DNA, 1816 bp, Homo sapiens
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 15746 - DNA, 1789 bp, Homo sapiens
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 15747 - DNA, 599 bp, Homo sapiens
agaagactggactcaattctgaaggtcgccaagaaggagagaacaatgtcttctttacccgtgccatacaaactgcctgtgtctttgtctgttggttcctgcgtgataatcaaagggacaccaatccactcttttatcaatgacccacagctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtccatcgaatcccgccatcatttgtgaagatggtgcaagtgtcgagagatatctccctgacctcagtgtgtgtctgcaattgagggagatgatcacactcctcattgttgaggaatccctctttctacctgaccatgggattcccagaacctgctaacagaataatccctgctcacattttcccctacactttgtcattaaaacagcacgaaaactc

SEQ ID NO: 15748 - DNA, 589 bp, Homo sapiens
tgctgggtactgggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccga

SEQ ID NO: 15749 - DNA, 406 bp, Homo sapiens
actttctagttgcgtgagtcctgggatccctaattccccacctgaaaaatggggtgagaacagaggttcccttgagaatgtactatgagcttataacgatgagggctgaagaaagtggtttgcaaagtgcagaatgcccttcagaaggtagccattgttaagaggacaaggttacagatgcaaggaagctgggctaagtgagggaggctgggagagctgtcaagcggctgcattgcggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatgg

SEQ ID NO: 15750 - DNA, 2257 bp, Homo sapiens
aatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcct

SEQ ID NO: 15751 - DNA, 2090 bp, Homo sapiens
atactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctct

SEQ ID NO: 15752 - DNA, 494 bp, Homo sapiens
acggctgcccaacccggtcccagccatgtccaacgtcccccacaagtcctcactgcccgagggcatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgcagcg

SEQ ID NO: 15753 - DNA, 2437 bp, Homo sapiens
tggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaa

SEQ ID NO: 15754 - DNA, 1402 bp, Homo sapiens
gatcctgtagaacttcggagattggggaagataatcggaagaggtagaagacaccgtccatgacacttcctggggaagcagatgtatgtataaggatggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccatt

SEQ ID NO: 15755 - DNA, 1284 bp, Homo sapiens
aaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagactgtctctcccctcctgggatttacagggtcatggctctgaaacattccgtagtgttctttggacacgagttttcgagatcgctttctgcaggcctcttggtactgtggcttcttttcagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgc

SEQ ID NO: 15756 - DNA, 4369 bp, Homo sapiens
tagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaacccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaa

SEQ ID NO: 15757 - DNA, 1035 bp, Homo sapiens
ctgtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggatggagtctcgttctgttgcccaggctggagtgcagtggcacaatctcggctcacttcaacctccgtctcccaggttcaagcaattctcctgtctcagcctcctgagtagctgggactacagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtca

SEQ ID NO: 15758 - DNA, 1110 bp, Homo sapiens
aaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgc

SEQ ID NO: 15759 - DNA, 2996 bp, Homo sapiens
tggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttat

SEQ ID NO: 15760 - DNA, 846 bp, Homo sapiens
atagttctagaagcttgtttctcccacctgaaaagactggatttgggacatgatcctgtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgac

SEQ ID NO: 15761 - DNA, 799 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtga

SEQ ID NO: 15762 - DNA, 6420 bp, Homo sapiens
agaacttcggagattggggaagataatcggaagaggtagaagacaccgtccatgacacttcctggggaagcagatgtatgtataaggataggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaa

SEQ ID NO: 15763 - DNA, 1852 bp, Homo sapiens
gacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatg

SEQ ID NO: 15764 - DNA, 1349 bp, Homo sapiens
acctgaaaagactggatttgggacatgatcctgtagaacttcggagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcacca

SEQ ID NO: 15765 - DNA, 554 bp, Homo sapiens
agatcatagggggtctggagggtgaaaaaaaagagtttggtgctcatggatggggctagtattggggtgtaggggagattaggtcaaagcaagaggattcaaaggagaaatgaattcctttagattggggaagataatcggaagaggtagaagacaccgtccatgacacttcctggggaagcagatgtatgtataaggatatggagtctcgttctgttgcccaggctggagtgcagtggcacaatctcggctcacttcaacctccgtctcccaggttcaagcaattctcctgtctcagcctcctgagtagctgggactacagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgca

SEQ ID NO: 15766 - DNA, 3018 bp, Homo sapiens
tgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcacccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 15767 - DNA, 2975 bp, Homo sapiens
tgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcacccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggc

SEQ ID NO: 15768 - DNA, 1378 bp, Homo sapiens
tccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccct

SEQ ID NO: 15769 - DNA, 3114 bp, Homo sapiens
tgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcacccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 15770 - DNA, 1466 bp, Homo sapiens
ctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcac

SEQ ID NO: 15771 - DNA, 449 bp, Homo sapiens
acaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgcacctgctgcttcttttactctgaaaataagaactagaggagtcatcacgttgcta

SEQ ID NO: 15772 - DNA, 4830 bp, Homo sapiens
gccctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcgaattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 15773 - DNA, 1626 bp, Homo sapiens
acatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattcta

SEQ ID NO: 15774 - DNA, 2287 bp, Homo sapiens
cagggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttc

SEQ ID NO: 15775 - DNA, 2085 bp, Homo sapiens
gtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcactctg

SEQ ID NO: 15776 - DNA, 1760 bp, Homo sapiens
gtcgtgggtgtttggtgtgaggctgcgagccgccgcgagttctcacggtcccgccggcgccaccaccgcggtcactcaccgccgccgccgccaccactgccaccacgtttcccttctcaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggattacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtctt

SEQ ID NO: 15777 - DNA, 1689 bp, Homo sapiens
gtgggtgtttggtgtgaggctgcgagccgccgcgagttctcacggtcccgccggcgccaccaccgcggtcactcaccgccgccgccgccaccactgccaccacgtttcccttctcaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtctt

SEQ ID NO: 15778 - DNA, 2055 bp, Homo sapiens
agatgccacgccccatagctccaccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaa

SEQ ID NO: 15779 - DNA, 2115 bp, Homo sapiens
ccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagggtcttactctgttgcccaggctggagtgcagtggcacaatcttggctcactgcaacctctgcctcccgggttcaagcaattctcctgcctcagcctcccgagtagctgggattacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaa

SEQ ID NO: 15780 - DNA, 1464 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcggg

SEQ ID NO: 15781 - DNA, 1592 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctg

SEQ ID NO: 15782 - DNA, 495 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtggagtctcactctgttgcccaggctggagtgcagtggcacaatctcagctcactgcaaccgctgcttcccaggttcaagccattctcctgcctcagcctcccgagtagctgggattacaggtgcccaccaccacgcacaggtagcatgcccaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcacc

SEQ ID NO: 15783 - DNA, 283 bp, Homo sapiens
ttctcacggtcccgccggcgccaccaccgcggtcactcaccgccgccgccgccaccactgccaccacggtcgcctgccacagacagaggacagaggtctcgctctctcacccaggccggatggttcactatagccttgacttcccgggctcaagtgatcctccccgctcagccccttgagtagctgggaccacaggtgtctgcaattgaactccaaggtgcagaatggtttggaaagtagctgtattcctcagtgtggccctgggcattggtgccgttcctat

SEQ ID NO: 15784 - DNA, 588 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagggtcttactctgttgcccaggctggagtgcagtggcacaatcttggctcactgcaacctctgcctcccgggttcaagcaattctcctgcctcagcctcccgagtagctgggattacagttttgagccagagtctcactctgccacctaggctggagtgcagtggcctgatcttggctcactgcaacctccacctcccggtttcaggcaattctcctgcctcagcctcccaagtagctgagactacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccg

SEQ ID NO: 15785 - DNA, 533 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagttttgagccagagtctcactctgccacctaggctggagtgcagtggcctgatcttggctcactgcaacctccacctcccggtttcaggcaattctcctgcctcagcctcccaagtagctgagactacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaaga

SEQ ID NO: 15786 - DNA, 546 bp, Homo sapiens
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtggagtctcactctgttgcccaggctggagtgcagtggcacaatctcagctcactgcaaccgctgcttcccaggttcaagccattctcctgcctcagcctcccgagtagctgggattacaggtgcccaccaccacgcacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaaga

SEQ ID NO: 15787 - DNA, 4764 bp, Homo sapiens
agcttgtaaaacaccctggagagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagttttt

SEQ ID NO: 15788 - DNA, 8946 bp, Homo sapiens
gcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggggaggcgccacctgctgcagaagtttcctcatcttttgtgatcctgtgtgtgtgcagtttaataatattaatagtgttaattgcaaactgtgtatcctgctgtaaggacccagaaatagactttaaggaatttgaagataattttgatgatgagatagatttcacaccaccagcagaagacactccctctgttcagtccccagcagaggtcttcacactttcagtaccaaatatttcactcccagctccctcgcaattccagccttctgtagagggattgaagtctcaagttgcccgccacagtctaaactacatacaggaaattggaaatggctggtttggaaaggttctcttgggagagatttacacgggcactagcgtagcaagagtcatcgtgaaggagttaaaagcaagtgccaacccaaaggaacaagatacttttttgaaaaatggagaaccttactacattcttcagcatccaaatattcttcagtgtgttggacagtgcgtagaagcgattccctacctcctggtgtttgagttctgtgacttgggtgacctgaaggcgtatctgcgcagcgagcaggagcacatgcggggggactcacagaccatgctgctgcagaggatggcgtgcgaggtcgccgcggggctggccgccatgcacaagctgcacttcctgcacagtgatttagccctgcggaattgttttctcacctccgacttaaatgtgaaagtgggagattacggaataggattcagcaggtacaaggaggattatattgaaacagatgataaaaaagttttccctctgcgatggactgctccagaattagtaaccagctttcaagacagactgctaactgcagatcagactaagtatagtaatatctggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggtatgaagtcttacagttctgttggctgtcaccagaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcttgtctttgttgcaggaaaacgtaagcacaaagggtgacgatacagatgtcatgctcacaggtgacactttgagcacctcattgcagtcttccccggaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggagaccccaaccaaagagctggggccctgtggaggagaggcgtgcggcccggacctgagcggcccagccccagcctcaggctctccctacctgagcaggtgcatcaactccgaaagctccaccgacgaagaaggtggtggctttgagtgggatgatgacttctccccagatccttttatgtcaaagacaacaagtaacctgctcagctccaagccttctctccaaacatccaagtacttttctccgccgccaccggcccggagcacggagcagagctggccgcactcggcgccttactcccggttctccatctctcccgccaacattgccagcttttccctcacacacctgaccgactcggacatcgagcagggcggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttttgtctcttcttgatgaagcggctttgccgcagcaaatgaggcttctctctgaggagctgagaggtcttgcagcctctccttgtcattctcccaccccacatcccattttttaaagcccttttggtaaaaaccaacaggttgtggccgcagacctcagatggacccggcccatccctggggacgtgctggcgtggcaggtccagagagctgcaccctgcacggggcaccgcaccgcttccctccgcgcagctcttctgcctggttttcggaggccaggctgctgggaagcttccgtgttcctgtcagtccttccttcaagaagccggggaactcaggcagactcatctccgcagagcataccagccgtgggggaccgttcgacttgatgatgtgtgcacacttcaggtggtggggacttgagctttaaaaaaacctccacagccgaatcttctcctccgagccactccacgtcacgtccagctgggcctggccagtctgtggttatccatgtgggatgagataacaccacatcctgcagctgtgaagggggatggacaagggacgacggccgacggcagagcatcagcagccgacacatagttcgggtcggggccttgggtggtcctgcatggcccgggactcatctcacggaccctccgttctgcattaagccccaggttctcttctggctttgaaagggcccgagtgctcccagtgtagcttcgtcacatcgtcacgagcccctgtggtcatgggcgacctcacacctccctccctgagttctgctctgacataaggaagtcctcggtggctggtgcagcgcggctgtgctgtgctggggaggcagccgttccttcgggggtccttgggcctgcagtcccctcatactcacccttcacccaacatattttccggtgctgatatgtttccagactccagcgcaacctggggtgctctccagacccgtgcaggggccgcctggggtacacggaaggaagttgagtcctagtgcaaaatgcaggcggacgttgccagagagtgcgcagcaaatgaccttcattgccagttccaccctactcctctcattttttatactaagcaataactttccaaagcaagaagttcaggatggagagagtcccctcctgtgtaggcatggggtggatgcggtgcccacctgggctatgtggggagcaccactgtctcgggatgcgcgaattttttttttttttttaattaacagggcattagaagatgattttgccaaaattgtcatgactctgaattcttgctgtggggacttcctgagttttctcagtttttacatctaagattagtcttggctgaagagaaatgagacgtgattatactactttttcaattgcaggtttaaggagttcagatttaatgaccaaagtcatacagatcatggaatctgtcgtcgtcttatacagtgtcagcctcgagtacatttattaaccttttggggctgtcagttttccactaggattaagattttggccgggcgcggtggctcacgcctgcaatcccaacacattggggggtcgaggcggacggatcactttgagcccaggagttcaagaccagcctgggcaacatggcgaaacctcgtctctactaaaaatacaaaatatatatatatatatatatactagctggggcacatagtggtgtgcacctgtagtcccagctgcttgggaggctgaggtgggaggatggctagagcccaggagatgggtgttgcagtgagctgagaccatgccactgtactctagcctgggtaacagccagaccctgtctcaaaaaaaaaaacaatttttttcataacataattcccatttttatttattttgagtcactcataattaattgccaaaaaagcattttatacattgagttggggggtagtggatcttagtgtggtgttgcatggaggggcgagattttatatttataatcaacacgtgggttaacatgtttttttgaaatccaagcaatacacaggaaatttaagtagaataaaaattgcagcccatttttgaaatgtcagcatgtgctgtgttcagttcaggtttttgttgtttgttttgttattttttaactaataagttggttatcagtggtgggttttcaaaatgtacttgttctaataagttgtacaatgaactaaatcagtggcattctctagataatgtgggggaaggttagaatattttctggccttctatggggtagcaacccagaatcaatctgaattagtcctgttttggtggagtttgtacattttaaatcctataacaaaaataatctagttttcatttccttactagctagatgcgaatttgtctttttgaatgaccctgtcaataagccagaaagggcaacccagaaaaagtgctccccacatccttctgagacttggcctgtgtgtgtggacgagaagccattcaccgtaagggtgcagaaagctcgaccaagccgaattgcaaacaacgttcgttctatttttaaatgtacaggttcgatcgtttctatagaaatgggtttatctaagaaaagtcttggtttgtcttgctgctgtaaaaggcctttccaaacccctccttttattcctgtttcccgaaataaggtatttgtagagttaaggacctactgcatgcctgtccccagggccccggtggaaggaaggcagcgcctgctcttccttaactcagcccatcatctgaaaattcagaagtgaaccaagggttagacgccagaggttgggcttctgttagagtggcttcaaaacatgagccttatgggaagtagccttaaaaaaagaatgggtatacgcagtgacttccgatggaaatctccaaaacaatattcctaagtagcaatggggttggctcaagtctttattaacaaagaacattctctttcatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaagatttttactgtatattgatgcatagtgtgattcaataaattgcttgtaatttaaaaactatttaatattcaaaataaatatagttatatatttataaa

SEQ ID NO: 15789 - DNA, 555 bp, Homo sapiens
tcctcggaactgttgcccacatgcagccccggacacagcccctagcccaaaccctacccttcttcctcggaggggcccctcgagacactgggctgcgggtgcctgtcattaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcaggtgggcagggtagagtaaacaggaggcatagctgcagcttctgtggcagagcttgccttagcttctcattctcttctttagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccag

SEQ ID NO: 15790 - DNA, 649 bp, Homo sapiens
cttcctcggaactgttgcccacatgcagccccggacacagcccctagcccaaaccctacccttcttcctcggaggggcccctcgagacactgggctgcgggtgcctgtcattaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccagtaagattgtggcaagacctggcactcctccaagcttggcacagtgagcccaccagctcagatggttgatcttaccataccctcatagtaccaagaatggactgccccctaagaaacctgtttgagaatcactgaattataaatataatccataggccttgaggcccaagatta

SEQ ID NO: 15791 - DNA, 861 bp, Homo sapiens
ggccgtggcagaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaact

SEQ ID NO: 15792 - DNA, 983 bp, Homo sapiens
gtggcagaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcggtgagccccccggccagggtccaggccgcgcctggggaaagagcagggcggacctcggggcccaaggacacctgtattccagatggagaactctgcggctcaaagagggaaagggagcaacccaagcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaact

SEQ ID NO: 15793 - DNA, 2193 bp, Homo sapiens
cgtgccgtaaagagaggccgggagctgcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaa

SEQ ID NO: 15794 - DNA, 1981 bp, Homo sapiens
ctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagc

SEQ ID NO: 15795 - DNA, 2101 bp, Homo sapiens
ctgcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagc

SEQ ID NO: 15796 - DNA, 3509 bp, Homo sapiens
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttattttaa

SEQ ID NO: 15797 - DNA, 2963 bp, Homo sapiens
agaagaccacagaaatgcctccaggaggcaggctgggatccagggtccaaccaatattcttgtgagagtgtgaagccaaggaacacgaaagaggggaacaccttggctaagaatgtattcgtgacagaggagaaggggaggaacaggaagcctccagctagtcgtttggaatctggcaaccatttctgtcagctttctcattcctagattgatgcagattgcttaattccttgagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaa

SEQ ID NO: 15798 - DNA, 2993 bp, Homo sapiens
gcgtttgcgagctaaggtcggagttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttag

SEQ ID NO: 15799 - DNA, 8227 bp, Homo sapiens
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaaaccagagtcaaatttgaaaataattgttccaaatgaatgttgtctgtttgttctctcttagtaacatagacaaaaaatttgagaaagccttcataagcctaccaatgtagacacgctcttctattttattcccaagctctagtgggaaggtcccttgtttccagctagaaataagcccaacagacaccatcttttgtgagatgtaattgttttttcagagggcgtgttgttttacctcaagtttttgttttgtaccaacacacacacacacacacattcttaacacatgtccttgtgtgttttgagagtatattatgtatttatattttgtgctatcagactgtaggatttgaagtaggactttcctaaatgtttaagataaacagaattcagccctggcctaaggggttatacttgtgaagactaatgagccaattgttatgtaccaaatctaagatatgtaccatagaatgaaataacctgcaagaatggtgatgcccacaatcagtattttgatgacaacacaagcacttttgaaaacataatgtcagttttaattcttctctctgaaagatgttgaagtggtcactttctgataaagttagattgccaaatgtcactgtatatctctccggaataattgtcttcccccatccccacctggacatatcctattttttcccctcactgagcattctgtctacataaaccaaccactgtgcagtactttacataccttaacccagttaattattgaaataattgtatgagacatctgttactatgatactccttaaagatgaagacagtaaataatttgcccacagttacagtcagtgggtgatggaatcagagttcagatttaaatccagattttttaatgctaatgattatgtttttaacctataccctacatagccatcaatttaaaaaaactgacttgtaatcaaaatttattaagtagaggctggcacagtggtgcatgcctgtaatcccagcactttgggaggctgaggcgggtggatcgcttgagctcagaagtcttgaaactagccggggcaacatagtgaggcctcgtctctacaaaaaacacaaaaattagctgagtgtgacagaaaaaataaagattataaaatgtattaagtagaagtataatgctggatgagaaattaagtgagaattgcacagatctcatgtttgcctttaacaacttaagattaatacataagtttattatttattcaacttttggtacggtaaaaaaattcaaagacagcatattgggcaacaaactaaattaagaaacctgcacatttggatgttcagtggcaagaagaccttcaagaatatcagtatcatcaaaataagtactttagtgttcaaaaatatgcctatgggtttttaaaaattatcagaatttcatatttagaccgagacaagagactcccaattttactgttatcctaaataaatctctacattccatctctagtccagttgtggctatgaagtgagcagttctaaacaatgacaaagattccagaccccacttgatagatatttttcacactttataatcaatttccactcaggaatcaataaagttattccatgtcataagtatttttaagatgtctcaggatctcacatactcaactaatgacccccttacaagaaataggtaaagggctgatagcaactcattacttgatgtggtacgagagccttagttctatgcaaagataaatggagaagcgtttttttcatggataattttacatggctttagagacacagaaacagataaattattacatgtataaaaattttagtaaaattgacattttaaatacatgcttatagattattggtatttaattgaaggtacagtacagaagagatagaaaaataaattttgccccactctgaaattgaagactgacctctgagcatgtccgctgagacacagtattctcctgtgatctgggacccagaataacaggaaagagaaactgatagatgttttcatcagcccaaggatgtatgtatcttacttgagtgaattcaacagtcccaggaccactgtagtgctgtaggtctgtgtaaagaaatgtagtgacagcacattaacctgagatcattgataccatcttggttcagcctcagttccccagataagtgaacaaatgaacaaaaatgcacttcagaaatattgaaattccaaggcactatttcatggacagtgctgaacaagtatagtttggcctattggtatgtatagacttagatcatatttattgtcaatgggcttgaattctgatttccacttttgaaagtttatttcactatgtatcattacattttattgggaccttgtgaaaactacctgccatgaaatactggattttcacataatttagaaaaaatttagaatgttttatgcctcagaatggtcaggaacttcccatttcttcccacagcttctataaaaaaaatttaaaaggaaggaggagctgaaataggggctatggtcttttaaacttataaatctggaatttttaatatttcattttaaggccttaaaccgaaacacaagctactaatcagtctttctaaatctgaccttcattgaaagcaactcagaaattaataatttgtgctgtggcttcaagtttaaatagattgtttgaagagaaatcatatgtcagggtttgcaggattacaggatttctaacttaaacccccaagaacaatgaaaaagttgacgtacatgtcactatgaataggcaccttctgttggatctctgtgtccatttagagatgagctacaagttgacaagaaaaataggagcagttttttttttctttttaaacctagtcaccaaatggtaaaaggacttggatgaaattccaataccagtgtgagattctggatttagaataaggttttataaccttaggcatgtcattcttctacttctcatttttccctaataaaacttattctctcttccataatatcatatatatggtcacattacttcaggaatatttatattacctcctccaaaactgaaagaaaataaactttaggctgtaagagttgagaattatgcatacagggctcacaggcggagttggacaatatgctgatggatcaagacatactgcaaccacaaagttccatctcacttagatgtggatgaaaaaagatctcttgctaaattattttctgtgaccttaaaagaaatttgtttcacttttcatctttcaagggtcatcttgatagttaccttaacaaacctttctcagctatttattattgagaaagcccattcttaaattttaagtcacaaaattatagttgtccactctactatgactgaaagaagcagcattcaagaaaaaatttaaacatagttaccaagaaatgtgaagaagtatttataaaaggaagctacataagtaggtaattttactctttcttaaccagtttaaaacagtaaagcacacctgcatctaatcacaatgttaggcgaacaacttaaaacatgatcagcctgtatgagaactgggatattgttacatattcagcctgtatgagaactgggatattgttgttacatgtatttgtataaacattaggagatgatttccatggcttttttttttttttttttaggaagtcttgctctgttgcccagctggagtgcagtgatgtgatctcggctcactgcaacccctgcttcccaggttcaagcgattctcctgcctcagcctccccagtagctgggattacgggcacaccaccatgcccagcttttatttatttatttatttattttggatttttagtagagatggggttttgccctgttggccaggctggtcttgaactcctgacctcaagtgatccgccctcattggcctcccaaagttctgggattacaggtgtgagagctgccgcgcctagcccttcatgaggttttatagtgaatgaattatttttctataaagtttatcaatatttattttggaaagctgctgaaaatgtctttttcaaaattaattatgcttaagatgtatggcattaaattcaattttatgaggctttctgacatatttactaaaaaaacctggaactgagactgaatttggaagacatttaattttgtagtgagatatctatattgtagatattgtacttttaaaacctgtcattaagtgtttggcatgtggttaatactttctctttagtcacaactggtattttaataaatgttataaacgtaagtgccaagatatgcatcactaactgttctatgaaatttgtctacttctcctttatgttcccaaagtcacagagaaagcagtgtactttatgacagtatatttatctttttatcattatgaattataagcagtgttaattttgagaaataaaagtccaaaaagaa

SEQ ID NO: 15800 - DNA, 2805 bp, Homo sapiens
gtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttaggaaatgcttgtagactacgtcctacctcgctgccgcacctgctctccctgaggtgtgcacaatg

SEQ ID NO: 15801 - DNA, 3079 bp, Homo sapiens
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaa

SEQ ID NO: 15802 - DNA, 5135 bp, Homo sapiens
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 15803 - DNA, 1523 bp, Homo sapiens
gagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaa

SEQ ID NO: 15804 - DNA, 4622 bp, Homo sapiens
gttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaa

SEQ ID NO: 15805 - DNA, 3173 bp, Homo sapiens
gctgcgtcgcgcacttccgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggacttttttttgcaggaagtgcattctctggtccttccctattttctgttctggatgtcagtgcagtgcactgctactgttttatccacttggccacagactttttctaacagctgcgtattatttctatatactaactgcattggcagcattgtgtctttgaccttgtatactagcttgacatagtgctgtctctgatttctaggctagttacttgagatatgaattttccatagaatatgcactgatacaatattaccattcttctatggaaagaaaacttttgatgatgaaacaataaagattttaaatatctattttagtttgtgggtgtttttgaaatgaaaatatatggcacactttcattctgaagtgcattaacattctaataaggtgatgtaaagcaagatgacattggtgtaatgttagagttgcagaagtttccattccaaaataaaatggaaaccatagttacagatattacaatgcagccctgtaattttgagctgtagtaaaaggattggtaatctgggaagtagaatttttacaaaatcttttacaaaaatagtcataaaaggttttgttgacatttaagactactactgatctaaaggcaaggtcctacttcttaaattttcagaacatttttatgacttcttattatgtatttattaccactcattattatagcatgttactttttgcaaacattttaaacaaaaaatatttctgtttggtacactgtgaagagagaaaagtactgttctgtattttc

SEQ ID NO: 15806 - DNA, 1389 bp, Homo sapiens
tcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgatggggcgcctacccttcttcagcaagatgggaacagctgagtctgaaggaagagaaacactgacacagcagctgcctctcccagcagccgccatgagaagattgttacctgcaagcagagtgtccactcaacccgtgctgaggctggcagacagtgctgagtcacttctgggcaggcctgctctgtgggctctaggattcctgctttgccctccctctcaggcacaatgacaactactgctcagtgccagacactgcaccatgtaggcaacacgtggcagtgatgattagtcacaaaatcacatttatattcattctaatgaaactgccattgcaaaattataactgagacagtgaaagaagtctgacctaaccaactccatcttgcttctaacctccaagctgtccttgttcattcccgggactcattttgggaggaacttagttaatagcttacagtttaaaacaaagacaatcacagacctttcccaaaacaaacccccttcttgcctggaaactagactgcctttgtaggattaacaaattagccgaaagattagaaattatggtttaggagtcatgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctgactccctatgatttcatctccaacccaaccaagcggcactgtcaactcactggcctccccctacccaccaaattatccttaaaaactcagatccccaaatgctcagggaaactgattatgattaccccaaagcttggagtaataataaaactggcctgtctcccgcacagccagctctctgtgaattactctttctttactgcaattcccctgtttgtctaggcagtggagaaggtgaacccactgggcggttacactaacattcacaacaatcttgcaacacagtattgtt

SEQ ID NO: 15807 - DNA, 4260 bp, Homo sapiens
cgcctggcgccccgcccgcgccttaggacccgcggggccgcgcggcgcatcctgcgggcggcggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccagcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcggggggggggggcaggggggggggtcaagatgagtttccctgtagattgtaccttggggtttttttctgtcgttttgttaaaattagcgccattttaatattaaaaatactgatttttaatattgaaaataaaagcatttaatatctcttaaa

SEQ ID NO: 15808 - DNA, 1260 bp, Homo sapiens
gaactgccatcagcagcgcccgacagcactctcctcctcactgcccaacactgggtggcaaatcttttcatcttggccactctgataggctggacagtgaggtccttcttcctagggcgcatggaaacctgttgcagtcacctgggtttgcggagtgggaggaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccacc

SEQ ID NO: 15809 - DNA, 1205 bp, Homo sapiens
agccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagt

SEQ ID NO: 15810 - DNA, 1370 bp, Homo sapiens
agccggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagt

SEQ ID NO: 15811 - DNA, 2993 bp, Homo sapiens
ggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggtgagagcagctggtgctgtggtgacccgttcccagagcgcccttggtttgcctttctcttccccaaatcccattgccagtggctgagacacgaaaggagcacttgggacaccagctccaacgccctgtcattatggtcacattgccttgtcctccctgggcctgctgtgaacgggatccaggtggggaaagaggtcaagacagggagcgatgctgagttcttggttccctccttgggccccacttcagctgtccttttccagagagtaggacctgctgggaaggagatgagcctggggccattaaggaaccttccttgtcccctgggaagtagcagctgagagatagcgagtgtctggagcggaggcctctctgaatgggcaggggtttgtccttgcaggacagggtgcaggcagatgacctggtgaagatgctcttcagcccagaagagatggacctctcccaggagcagcccctggatgcccagcagggtccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggtttttttt

SEQ ID NO: 15812 - DNA, 2585 bp, Homo sapiens
actccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggtccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggtttttttt

SEQ ID NO: 15813 - DNA, 2705 bp, Homo sapiens
atgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggtccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggttttttttacttggtttgttcagacaatggaaatttgcccattctgtc

SEQ ID NO: 15814 - DNA, 453 bp, Homo sapiens
agaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagaggggcgttgtgttagtccgttttcacactgctgataaagacgtacccgagactgggcaatttacaaaagaaagaggtttacttggacttacagttccatgtggctgggg

SEQ ID NO: 15815 - DNA, 2451 bp, Homo sapiens
aggtctgagggagcgatggcggtacgcgcgttgaagctgctgaccacactgctggctgtcgtggccgctgcctcccaagccgaggtcgagtccgaggcaggatggggcatggtgacgcctgatctgctcttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggtccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggtttttttt

SEQ ID NO: 15816 - DNA, 4370 bp, Homo sapiens
ccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaa

SEQ ID NO: 15817 - DNA, 3709 bp, Homo sapiens
gcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaa

SEQ ID NO: 15818 - DNA, 4298 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtgacttctgcccaagagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcagcaatgtggttctaatttttttccactgagaaagaagatctttaatttcatattaatggttctgtatattttgggtcatctttttattttttaagaatatcaagtcaattcatttttctttccctatttaaaaaaaaaggtgttttcacagaatgagtgcacttaaaaagtgaagtgaaggaggaggtaacagtagagacgatggcaatatcatcaaggacaaaagtaaaaacgtttagctacctgctgatttttagtgactgttcatatatgttgtatttcaagtatggctggtgaagccagtcagcttttcgggacgttagcaagtggaaactgagtcagtatcatccaaaaccatatctagtcttaacacatggagaatgctggagtgagggttgtgagttcagggtatataatcaagaaaacactcccagcataatgctaggggtcaccagtgtccatcccccagaactgtatggatctaggatatacacagctgcgttgcattaagaaagagatgaaatctctattaaaatacacaagatttttgtatctccttgtgcagaggatatttgccactgcccattgggaagcagacaagttatagggggctgggggccaacactggcaagtaggaaaccacgggtcggacaggtgagcaaaatgtgctggcaggtgggcaccactgggagacccacactgcacacccgggcaccgtatgaacaggaaagaggaaggaagctggacgaagcccctcagggaccctgtgctgaccatgctgggcccaccggcaaaagggagatattcagttccttgtctcatccttaaggtttcttccacaacatctgaatacaagcatgtttaactgggaaaatgtctatgtcatgcgtgaataacaccagcagcaaacactcacacatcacgcagacacggccggcagcatgctgacgcttttaggtatttttcactcatgcaattttcacatattttcactcatttcatttgcacggaaattctatgaggtagatgctgttatcaaatccacattacagatgagggacccagggtccaggaaggtgaactggcagaagtctcccagctggtagaacagggctgcaaggcatcgattcccaggtgtctcacagccctgagaagatggcgttttccctatcagtggctctgaggaagtcaagccttcagtctctacctctcccaccaattcttttggaaacagcaaaccaatgttacacacacttcctaatccagaggaagctagaacacgatttttaaatttatttagtaaaataaaactttttttgcagatgtaacg

SEQ ID NO: 15819 - DNA, 3365 bp, Homo sapiens
cggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagt

SEQ ID NO: 15820 - DNA, 2775 bp, Homo sapiens
ggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttca

SEQ ID NO: 15821 - DNA, 3208 bp, Homo sapiens
tggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttt

SEQ ID NO: 15822 - DNA, 2821 bp, Homo sapiens
gtcgtcgaccctgtggccccgcccatccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggtaactcaaaa

SEQ ID NO: 15823 - DNA, 3814 bp, Homo sapiens
gtcgtcgaccctgtggccccgcccatccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttt

SEQ ID NO: 15824 - DNA, 718 bp, Homo sapiens
gtttaaaataatattttttcaagataacattttattttgaggataaatctatatgaaaaagtgcagttattggagaatgcagtgttgcaaatagaattagttggcagggactccacggttgttgtggtttgaatatcttgcagcactaaccctgtttaaccaacgtcatgctctgtttaacagatgcagagataatgacctagtattataatatgtagaataagaatttcagaaagtgtgattcatttcgaaggtagatcactcactttgtgaatcattgctatgaatctgaaaattgaaatagaggaaacctaagttcgtatctgcctaatgagatggcattctttactcattttataggaagtgttgtattatgttttgttaggtctgttgctggatatttatcatcgtgaagaatgatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 15825 - DNA, 389 bp, Homo sapiens
gaagagaatgtggatgtagtaatgaaacaagagagaaggagagcgggatgtgggaagataaatgaaggggtctagatgtaaatgtcagtggaaaggagagctaccatcactaaggtttatattctgcaagatcctgaagatactttccttcttttctggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 15826 - DNA, 352 bp, Homo sapiens
taatgggaagagaatgtggatgtagtaatgaaacaagagagaaggagagcgggatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 15827 - DNA, 2522 bp, Homo sapiens
catccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaa

SEQ ID NO: 15828 - DNA, 3381 bp, Homo sapiens
atggctccaggacccttctcctcggccctcctctcgccgccgcccgctgccctgccctttctgctgctgctctgggcgggggcatctcgtggccagccctgccccggccgctgcatctgccagaacgtggcgcccacactgacaatgctgtgcgccaagaccggcttgctctttgtgccgcccgccatcgaccggcgcgtggtggagctgcggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtctgtatgtgtgtccgcgtgtagtgtgtgtgtgtgtgtgtgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagct

SEQ ID NO: 15829 - DNA, 3270 bp, Homo sapiens
tatgcgcgcgcgcgtggggggcagtgtgcatgcggggagtacgggggagtgtgtttgtgtgtgcgtgtgggtgtgagtgcctggctccctctcgctgagacacacatacactcacacatacacaacccggcaggctcgtctgaacttgaagacaccccacattccaagatgcccgaggttcctgggaatgcctggggttcttcgatccggaaaatcctaccggcatcctcctagggagggattattattattatttttctttaatctggaagagaagagaacaagttgtgcttttccccccttcttcttgctaaatgccatggatataactgaataagcggctcagggctttccccgcgtggacgtccgaggccaccatctgcctgcattcgccggagccgccggagggtttagctcgagtctgtctcgggcggggaaggatgcgtggccgagccggggagcccgggcgccccgcggagccggcctcggtgccacccagccgggggtagatgctgcctcgcccaggcgctgagtgaccagaccatggagaccctgcttggtggcctgctagcgtttggcatggcgtttgccgtggtcgacgcctgccccaagtactgtgtctgccagaatctgtctgagtcactggggaccctgtgcccctccaaggggctgctctttgtaccccctgatattgaccggcggacagtggagctgcgcctgggcggcaacttcatcatccacatcagccgccaggactttgccaacatgacggggctggtggacctgaccctgtccaggaacaccatcagccacatccagcccttttcctttctggacctcgagagcctccgctccctgcatcttgacagcaatcggctgccaagccttggggaggacaccctccggggcctggtcaacctgcagcaccttatcgtgaacaacaaccagctgggcggcatcgcagatgaggcttttgaggacttcctgctgacattggaggatctggacctctcctacaacaacctccatggcctgccgtgggactccgtgcgacgcatggtcaacctccaccagctgagcctggaccacaacctgctggatcacatcgccgagggcacctttgcagacctgcagaaactggcccgcctggatctcacctccaatcggctgcagaagctgccccctgatcccatctttgcccgctcccaggcttcggctttgacagccacaccctttgccccacccttgtcctttagttttgggggtaacccacttcactgcaattgtgagcttctctggctgcggaggctcgagcgggacgatgacctggaaacctgtggctccccagggggcctcaagggtcgctacttctggcatgtgcgtgaggaggagtttgtgtgcgagccgcctctcatcacccagcacacacacaagttgctggttctggagggccaggcggccacactcaagtgcaaagccattggggaccccagcccccttatccactgggtagcccccgatgaccgcctggtagggaactcctcaaggaccgctgtctatgacaatggcaccctggacatcttcatcaccacatctcaggacagtggtgccttcacctgcattgctgccaatgctgccggagaggccacggccatggtggaggtctccatcgtccagctgccacacctcagcaacagcaccagccgcactgcaccccccaagtcccgcctctcagacatcactggctccagcaagaccagccggggaggtggaggcagtgggggcggagagcctcccaaaagccccccggaacgggctgtgcttgtgtctgaagtgaccaccacctcggccctggtcaagtggtctgtcagcaagtcagcaccccgggtgaagatgtaccagctgcagtacaactgctctgacgatgaggtactgatttacaggatgatcccagcctccaacaaggccttcgtggtcaacaacctggtgtcagggactggctacgacttgtgtgtgctggccatgtgggatgacacagccacgacactcacggccaccaacatcgtgggctgcgcccagttcttcaccaaggctgactacccgcagtgccagtccatgcacagccagattctgggcggcaccatgatcctggtcatcgggggcatcatcgtggccacgctgctggtcttcatcgtcatcctcatggtgcgctacaaggtctgcaaccacgaggcccccagcaagatggcagcggccgtgagcaatgtgtactcgcagaccaacggcgcccagccaccgcctccaagcagcgcaccagccggggccccgccgcagggcccgccgaaggtggtggtgcgcaacgagctcctggacttcaccgccagcctggcccgcgccagtgactcctcttcctccagctccctgggcagtggggaggctgcggggctgggacgggccccctggaggatcccaccctccgccccgcgccccaagcccagccttgaccgcctgatgggggccttcgcctccctggacctcaagagtcagagaaaggaggagctgctggactccaggactccagccgggagaggggctgggacgtcggcccggggccaccactcggaccgagagccactgctggggccccctgcggcccgggccaggagcctgctccccttgccgttggagggcaaggccaaacgcagccactccttcgacatgggggactttgctgctgcggcggcgggaggggtcgtgccgggcggctacagtcctcctcggaaggtctcgaacatctggacgaagcgcagcctctctgtcaacggcatgctcttgccctttgaggagagtgacctggtgggggcccgggggacttttggcagctccgaatgggtgatggagagcacggtctaggtgggggtgggcatgctccctttcctgtgcgcagggtgggagaaggggaaagaatctcactggcaagtgtttgtggagtttccatggtgatgtttacatccagggacagtttcgtctccctgtcaatggcctcgtgtccccccctaccccgcaacacccacatcacctccccaccacccggccggggtgtgctcagggaatgtggactcgctcaaatgccggactgagccctgagtgtttggaaaggcgagactccgcctttctaatcacaaatgtagcctacaagcaagcggctttggattgcttatgggtctagtgttgtttttatttcttaatttattttttttccatttccca

SEQ ID NO: 15830 - DNA, 2513 bp, Homo sapiens
ccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaagcttgggcg

SEQ ID NO: 15831 - DNA, 3689 bp, Homo sapiens
ctccatgttggccaggctggtctccaacgcctgatctcaaaagatccgcccgccttggcctcccaacgagccgggattacaggcgtgagccaccgcccccggctgtcagtgtgtcttgaggtctttccctaatcccagatggcacaagttttccctcttgcaggcagagaaaggagccttgggaaggagcccctctggcctgaaagatcaagcctattgctgggcatggccagattgaatcgggaattccggaaacccgagcctggaaccctgatctgggaccagcaccccgagatccggccgtggaaccccaagatctggagcctgaaccccagtatatggggctggaatctcaacatcggtcactgggacctcaatatttggagccggaaccccacaatttggaacacagaccccaatatttggagcagaaccccaagatttgacatctaaaacctcaagcctggagctgaactctgaattctgggcctgggaccttgaaatctgggactggatttccagtactgtaccctggaacccactcttggggacctgaaccctgggattcaggcctcaaattccaagatctggactgtgggattccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaagcttgggcgaagacccttgccctcgtctctgtctatgggggttgggggacggagcaggggtctggagctggggaatgcctcctttggggagacaccccctccccgcccagttcagtctgaggaccccggaggaggctgaggatggcgatccattcagacaatagatgttccctgcgtgtcggctctgagcatgccctgggttgggggatgctgtggtgatccagatagccctgagccctgcccgcaggggcctaaagtcaaatgggagacagacacatccccagacagtgatagcacagagtgaccagggatgtggggatgagggaagcctgggggattgtgacagtccagaagaggtacccttgctcagccccaggtgtggtcagggagggcttcctggaggaggacacatgtgatctgagaatgacatatgaaggagataactgggcaaagagcagaaggaaagctctttcaggcagagggcacagcacaagcaaggtggtggtgtgccctgggcactgggggtgctatggtagaggtgaggcaggagggttgagcagggtctaggacctccaggctgagg

SEQ ID NO: 15832 - DNA, 2431 bp, Homo sapiens
cttgtccccagcgcctggactcccccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccagtacaacagcagcgaagatgagaccctcatctaccggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 15833 - DNA, 3723 bp, Homo sapiens
atttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagaatgatacctcctacgagcaaaacttttctggtcaataatctggctgctggaactatgtatgacttgtgtgtcttggccatatatgatgatggcatcacttccctcactgccacaagagtcgtgggttgcatccagtttactacggaacaggattatgtgcgttgccatttcatgcagtctcagtttttgggaggcaccatgattattattattggtggaatcattgtagcatctgtgctggtattcatcattattctgatgatccggtataaggtttgcaacaataatgggcaacacaaggtcaccaaggttagcaatgtttattcccaaactaacggggctcaaatacaaggctgtagtgtaacgctgccccagtccgtgtccaaacaagctgtgggacacgaagagaatgcccagtgttgtaaagctaccagtgacaatgtgattcaatcttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactcaactgccttgcagttagctagccgtcctcccgattctgtcacagaggggcccacgtctaaaagagcacatataaagccaaatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaa

SEQ ID NO: 15834 - DNA, 3055 bp, Homo sapiens
gcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtg

SEQ ID NO: 15835 - DNA, 552 bp, Homo sapiens
attattagctccatctaagagacaggaagacggagattccaagaggctcagggacttgcccggggtcacctggctgaccagtggccttgtcaggcctccacccagggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctt

SEQ ID NO: 15836 - DNA, 2677 bp, Homo sapiens
agaggataattccccattatacagagatatttagcctaatagaagccgacagatcattcagggcagtaatgtactccggcttcaagcgtgtagtttcctcagcctgaactcccagattaaaggctccttgcccagcccgccctgtgccggtgcctgtgaccttgactgcaatgatgggggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaacta

SEQ ID NO: 15837 - DNA, 2368 bp, Homo sapiens
aggtggatacatttgcaaagtggaatcctccaggtgcctttaaggagtttacagtctagtaggtatgaatccagccatcctcagcagtggcaccgatatcttcaaaagtgtcgtttgtctggctctctgccttctggatgggaagcctaccctgatgtctctcttcaaatctgataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggaca

SEQ ID NO: 15838 - DNA, 3048 bp, Homo sapiens
tgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtgaagtgagaaaaacagaatgcagctttcaaggttggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaaagagtaaaccaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttgatacagaa

SEQ ID NO: 15839 - DNA, 2130 bp, Homo sapiens
ggcggcggcggcggctgctcgtgtcggctccgggcggcccccgcgccgcagcccgcgccgtgtccgcggcggagccgcccaggtgcgcaggaggatggtggcgcggccctaggcccacgctccgcaccatgacctgctggctgtgcgtcctgagcctgcccctgctcctgctgcccgcggcgccgcccccggctggaggctgcccggcccgctgcgagtgcaccgtgcagacccgcgcggtggcctgcacgcgccgccgcctgaccgccgtgcccgacggcatcccggccgagacccgcctgctggagctcagccgcaaccgcatccgctgcctgaacccgggcgacctggccgcgctgcccgcgctggaggagctggacctgagcgagaacgccatcgcgcacgtggagcccggcgccttcgccaacctgccgcgcctgcgcgtcctgcgtctccgtggcaaccagctgaagctcatcccgcccggggtcttcacgcgcctggacaacctcacgctgctggacctgagcgagaacaagctggtaatcctgctggactacactttccaggacctgcacagcctgcgccggctggaagtgggcgacaacgacctggtattcgtctcgcgccgcgccttcgcggggctgctggccctggaggagctgaccctggagcgctgcaacctcacggctctgtccggggagtcgctgggccatctgcgcagcctgggcgccctgcggctgcgccacctggccatcgcctccctggaggaccagaacttccgcaggctgcccgggctgctgcacctggagattgacaactggccgctgctggaggaggtggcggcgggcagcctgcggggcctgaacctgacctcgctgtcggtcacccacaccaacatcaccgccgtgccggccgccgcgctgcggcaccaggcgcacctcacctgcctcaatctgtcgcacaaccccatcagcacggtgccgcgggggtcgttccgggacctggtccgcctgcgcgagctgcacctggccggggccctgctggctgtggtggagccgcaggccttcctgggcctgcgccagatccgcctgctcaacctctccaacaacctgctctccacgttggaggagagcaccttccactcggtgaacacgctagagacgctgcgcgtggacgggaacccgctggcctgcgactgtcgcctgctgtggatcgtgcagcgtcgcaagaccctcaacttcgacgggcggctgccggcctgcgccaccccggccgaggtgcgcggcgacgcgctgcgaaacctgccggactccgtgctgttcgagtacttcgtgtgccgcaaacccaagatccgggagcggcggctgcagcgcgtcacggccaccgcgggcgaagacgtccgcttcctctgccgcgccgagggcgagccggcgcccaccgtggcctgggtgaccccccagcaccggccggtgacggccaccagcgcgggccgggcgcgcgtgctccccggggggacgctggagatccaggacgcgcggccgcaggacagcggcacctacacgtgcgtggccagcaacgcgggcggcaacgacacctacttcgccacgctgaccgtgcgccccgagccggccgccaaccggaccccgggcgaggcccacaacgagacgctggcggccctgcgcgcgccgctcgacctcaccaccatcctggtgtccaccgccatgggctgcatcaccttcctgggcgtggtcctcttctgcttcgtgctgctgttcgtgtggagccgcggccgcgggcagcacaaaaacaacttctcggtggagtactccttccgcaaggtggatgggccggccgccgcggcgggccagggaggcgcgcgcaagttcaacatgaagatgatctgaggggtccccagggcggaccctcccctcccctcccccgcgggccggccgctcgcgtgtccacctatgcatttcccggaggggaaggggacggctgcacggcgctccccaggcagaacttcccctttttttgtagacgcccaaccgcaggactgtttttcatcagcatgcgtcttttttgcagtttctcaagcgttttctaaagatttcaacccgtcttcctgtc

SEQ ID NO: 15840 - DNA, 3146 bp, Homo sapiens
agagacgcccttgtcgccatgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcgct

SEQ ID NO: 15841 - DNA, 3376 bp, Homo sapiens
gtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatcgtgagtgtcaccccggtccccgtcacccaatcccagagccccgcccctcccctgaggggtccgtagtcccattccgagaccccagtaccgcggcgacccctgctccctcgagcacttgttgtgtgcactttagttatcaaaacagtctatgtggaaatccagtcccgctcttcattcggagagtccgcgattcctagagcctcagacttcgtcatcccggtctgcgtgactttatgagattctgagtttctgttcccagcacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 15842 - DNA, 2849 bp, Homo sapiens
atcaggaagggggtgcaagagggttagtgattggggagcagaaggggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 15843 - DNA, 3044 bp, Homo sapiens
tgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 15844 - DNA, 808 bp, Homo sapiens
ccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaagcagaagacaactagctgacacctgttcagccagcaagttggtgtttttctgaaatgtacactgatgttttatctttatgccattagacttgctaattaaaaattctgcccttaaactctcaggaggagaagaagacaggaagccctcaatacactctaggtgtatggtatcagttgcagagaaaacagtggtat

SEQ ID NO: 15845 - DNA, 3180 bp, Homo sapiens
ggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcagttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggc

SEQ ID NO: 15846 - DNA, 2592 bp, Homo sapiens
gttaatattttatcattagggaaaaaaacagcaaagctattttcagcttgaaatgaaaaaaggttgataaaggggattggggcttaggtgattaaaggcaagcatgtgagtcagacatggcctcccagcccctgccggactgttgcgctgtcgccggacactcaagttgctatcaggagcacttttctctgtcaaagtgactggcttttgtcatgcaatccccaagttataatgggagggtaggataggccccagagcagtcagctgagccagccccgctcagtgagtctgtcctctggggctcgccatgcccccagcctccgcatggggaacaccatcagggccctcgtggccttcatccctgctgaccgttgccagaactatgtggtcagggacctccgtgagatgccgctggacaagatggtggatctgagtgggagccagttacgccgcttccccctgcacgtgtgctccttcagggagctggtcaagctctacctgagcgacaaccacctcaatagcctgcctccggagctggggcagctacagaacctgcagattctggccttggatttcaacaacttcaaggctctgccccaggtggtgtgcaccttgaaacagctctgcatcctctacctgggcaacaacaaactctgcgacctccccagtgagctgagcctgctccagaacctcaggaccctgtggatcgaggccaactgcctcacccagctgccggatgtggtctgtgagctgagtctccttaagactctgcatgccggctccaacgccctgcgtttgctgccaggccagctccggcgcctccaggagctgaggaccatctggctctcgggcaaccggctaactgactttcccactgtgctgcttcacatgcccttcctggaggtgattgatgtggactggaacagcatccgttacttccccagcctggcgcacctgtcaagtctgaagctggtcatctatgaccacaatccttgcaggaacgcacccaaggtggccaaaggtgtgcgccgtgtggggagatgggcagaggagacgccagagcccgaccctagaaaagccaggcgctatgcgttggtcagagaggaaagccaggagctacaggcaccagtccctctacttcctcctaccaactcctgaggagcttcagttgcaagtcaatgccaaggacccaactgcagcatgttctggaagcctctccattggagtggaaaggatggctctgggtcatttgggagtggctctgctagtagagactgatggagagagccaggtggaatgccataaatcacactgagaaaatatttctggcaaacagctcctcttccagaggggagttgtgtgccaatgatggcatgacaatccagagatcataacttctttgcaagaaaacagcttctccacacatgtattttgaaacactgaagagcaaaaggggctgggacactctgaactcctgcactctccagaagtgactggtcatgaagctcatgagctcctcaaataaggtatttgccatagaactaaatattctggtggtctgtctctttgcaggacatattttctttactgtaaatgaccataaacagtatcaatgtatcactgaggccaccgaaaaggacatttctacctaggcaatcagtcagattcacagaaaaaagttgtttgttgttgtaaaggctcaagatgaaactctttccccagcagtttagtgcctgctgaaaagatccctgatggacaatacttcttggtggactccagctgccccttttattattattagagacaaggtctcactctgttgctaggctggagtgcagtggcacaatcatggctcactgcagccccgaactactgggctcaagccttcctcccgcctcagcctgcccagtaactggtactacagatgtgcacacctggctaagtctttaattttttcgtagagatgaggtcttgctatgttgcccaagctagtttcaaactcctgggctcaagcgatgctcctgcttcagcctcccaaagtgctggggttacaggcatgagccaccacacccagccttcagctgtcaccttaaacttgacagtggctcatgctgatttagttcattttccctaaaaggtttgtcccaagatctgctcccaacagttgactgtcactgacaatgttggaagtcatctggaaaagagaacctctgtggtaatgtggtctcattaaagtcaagccttgttgtgattcctgtctacctccctgaagcaaagcccttctgtttattcacactaatgagccagagctgagctaaattgaatccctgtccttggaggaaaaccacatttccagaagcatgttagtttaaaggtagtaggtgagaaatgtgttctcttgaaacaagcactttgaaatttgaataggaagttgtagtgtatataggaagtctctgcctctttcgcctagtatctctgcctttgtttcaatttgttttgatttttacagactgttttgacaatgtataaaccaaggtattttgttttttggaagtatgtaaattgtgaccttcccacaaatatataaacttt

SEQ ID NO: 15847 - DNA, 5431 bp, Homo sapiens
tgggcgggagctacgccggcccaagccccgccggggaccagcgagccgggaggaggagcaggcgccacagccgccccgcgccccgcgcccgcttgtaatccggtccgctccttattcagccgccgggaactgcgaggaggcgtcatgtagcagcagcagcaaatccgcctcgcatttgcaactcttttttttttttttggtggggcggggggcgcgcggcaaaattctgtctccgcccccccttttcttgcccacttccatttgcaagctgcatctgcctctctaaaaaaattgaggagttcggggaagggcagggggccataaatcagagttggacctgcaataacccccacacctacagggcaaccatgaccgaggagagctctgacgttcccagggagttgatagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtgtgtcctctttaagtattcaatttgccaaactcccaaagggattaaagcacttaaatttatctaaaacctcattatcacctaaaggggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaagagagctgcgtgtgcgcagaagaagcttgggaatgatgccgtatcccaggattcttccagcccagctttgagcggcgtagaacggtcggatggaggtggggcagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaa

SEQ ID NO: 15848 - DNA, 1163 bp, Homo sapiens
caaaattctgtctccgcccccccttttcttgcccacttccatttgcaagctgcatctgcctctctaaaaaaattgaggagttcggggaagggcagggggccataaatcagagttggacctgcaataacccccacacctacagggcaaccatgaccgaggagagctctgacgttcccagggagttgatagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagagaaaccactaccaagatcaagagacagaatgttcccaccgttctccagacttaccttgtggtttgccccagtgattaccagccctgtcctctaccacttggaaaagataactactattctgacttctctcatgatggatga

SEQ ID NO: 15849 - DNA, 5296 bp, Homo sapiens
tgggcgggagctacgccggcccaagccccgccggggaccagcgagccgggaggaggagcaggcgccacagccgccccgcgccccgcgcccgcttgtaatccggtccgctccttattcagccgccgggaactgcgaggaggcgtcatgtagcagcagcagcaaatccgcctcgcatttgcaactcttttttttttttttggtggggcggggggcgcgcggcaaaattctgtctccgcccccccttttcttgcccacttccatttgcaagctgcatctgcctctctaaaaaaattgaggagttcggggaagggcagggggccataaatcagagttggacctgcaataacccccacacctacagggcaaccatgaccgaggagagctctgacgttcccagggagttgatagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtgtgtcctctttaagtattcaatttgccaaactcccaaagggattaaagcacttaaatttatctaaaacctcattatcacctaaaggggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaa

SEQ ID NO: 15850 - DNA, 1963 bp, Homo sapiens
acttcaaagggcaaaagaaagaggagaacctccgcttaccacagccgggtagaaatgcctgaggaaagcagcggagctgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataa

SEQ ID NO: 15851 - DNA, 5100 bp, Homo sapiens
cattccacaccctccgggatctccagtgtgaaaatgtctggccctgggtaggaggctgcagatagtccctgggccggggctcgcgctggccggctgcagcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaaaaaaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttatttacatggcagaatacatgtatgaatattaaagt

SEQ ID NO: 15852 - DNA, 2402 bp, Homo sapiens
gccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggtaggactgaggctctagaacttgcacctgtgcagggactgcaaaccagacctgggaggaccctttcagcagcccccactccaccctatcccaggacttcccagcgacccgccgttctgggagataccgggagcgtgatcagggggcggggccgtttccaaggcaaccgcttatttgcatagggtcccgtcctggccaacgagggcgccccaaatgttcaggacatagaagaaggggttaactggcccggatctcctcctcgccttccaagcccgctaagcactggggttatctacccattccccagaaggggagactgaggcagcccaccagccaaaggaggcgaccagactggggctgcgttttaccatttcagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcctgcccctccactcccgactatgagaacatgtttgtgggccagccagcagccgagcaccagtgggatgaacaaggggctcacccttcagaggacaatgacttttacatcaactacaaggacatcgacctggcttcccagcctgtctactgtaacctgcagtcactgggccaggccccaatggatgaagaggagtacgtgatccccgggcactgagcctaagatgtcctaacctccacccagaaccccttcagtccctgctgggtgactcagggcgtcctaacgcctccatggcctcagtttccccatctgaagaatgggtacaggaaaggattgtccttgaggccccaggaagctctgccgccccctccctgtccctcatgccgctcctcagctccctcagctcctagagggggaagaggagagacccccaacaaggggacaggacggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttgttgttgttgtttgtttgtttgtttttgaaactgagtgtcactctgtcacccaggctggagtgcaatgctgcggtctcagctcactgcaacctccgcctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccgcctcggcctcctgaagtgctgggattacaggcgtggccactgcgcccaggcacattcctcccttctgcccctctcagggccccttcccaggtccctgatctccaggcttggcctccagagcagcccacaccaaccccaaaataaaaaaatgtatatattccttt

SEQ ID NO: 15853 - DNA, 1209 bp, Homo sapiens
aatatttgtgcaggcgccgcaggaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaggtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgcctttgccctccctttacactgtctgccggcgtcaacaagcgacacagaccgaaaa

SEQ ID NO: 15854 - DNA, 4054 bp, Homo sapiens
aagaaagaggggcagaggagggaaggcgactgcagtccgaaaggagcttttggaagctaggaccctaagcgtcaggacgtggcattggtcgagagaaagcctgggctggcaagagctgccgccggtgctgggagagcatttatttgggagaaaaagaggggagagagcagagggagggggaggaagagagttcaaaccgaagtggatggaaggggactggggtttctgccgcgcagggagccgtgagccagggcgatggcgctaagggcggcgcggagcagctgcgctcccgagaacgcgtctcctcgcagaggactagcagacatcgggaaggtctgcgccaacgggaaccaacttgtggctccaaaatgtacccaacgcagctggaaatgagatcaaagctgcagttgcatttgagaaggatgagaagagccagcgattagggaattttttttttacccgttttcttcctttttctttttttcttctttttctttttttctttcttttttcgtgtgtgttttttttaatttgcctaccaccctgtctgtcccctcacttcgccctccccatttgaaataaaagccccagtctcaacttccatcacctcggcgctcccggagccactaccggctgatggaggagaaggggacccgggggctggcaggggccaccggcgagggaccgcatcctgcgtctcccccgtgatcccggccccgaccgcggagttctgcaacacctggaggatctggaccgggtgctgggggtgggggcggggacagaggaaggaaaggcaccccgagccttaaaaagaaaaaaaaaaagtagcggggggaggaatgggtttcttcttgacagctgacggagccttgaaattttcctccactacctccgcccccgcccccgcccccgccccccgcactccatttaacgtgagattatgaaattgcagaggcggtggagggaaggagacaggatataaccggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagac

SEQ ID NO: 15855 - DNA, 3085 bp, Homo sapiens
ggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaa

SEQ ID NO: 15856 - DNA, 2650 bp, Homo sapiens
ctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaagaaatggttctctttactgcgaggctgcaaggtcacccaatgagagaggggccaaataagctggaacatcatctaatacactgaatgtaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 15857 - DNA, 2669 bp, Homo sapiens
ggtatttcgtacagtaggagatttcaacaacgtgacaatattctctaggcacttgggctcactgtctgtagcccccaccccccgcctttcgccacctccttgcttccctactcccccttctgcttttgcctttgatgagtttttggcttactttttggcggagtctcttggacacgtttttgctggtgctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 15858 - DNA, 583 bp, Homo sapiens
acttctcaggcaaagagcatgccaacagcctttctcttctgctttgcttgtctgtggtggatactagcaacctatgtggttctaaagtatcaagctgagattatagtatcaatgagttggaacatcaatagtgccaagtgccatttaaaaatcttttcatcttcttgtgtgttgcttttggagaggaaatgttttcagatgtggtttctagccttgcagaaaaatggcattttcaggctgtatgggactcttacatcatctagtttcaatcacctcattttgcagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctg

SEQ ID NO: 15859 - DNA, 5000 bp, Homo sapiens
ttctgcgtttctctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaac

SEQ ID NO: 15860 - DNA, 6500 bp, Homo sapiens
gcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagtgagcccgctacatgaaaaaaaatgcaagtcaaagtggtcacaacctagaagtctgcagagacaggaataactagcaatgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcactt

SEQ ID NO: 15861 - DNA, 567 bp, Homo sapiens
ttctgcgtttctctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaaaatt

SEQ ID NO: 15862 - DNA, 5536 bp, Homo sapiens
aggtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcactt

SEQ ID NO: 15863 - DNA, 2375 bp, Homo sapiens
gtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagttgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaacatctgaagatccagagtgtgccccttgcccaatcgcctgagactatacagtgacacctacaacagaggatgtggagggagcagcttttcgggcaccagaaatggcagcatcaggagcatcagcacgaatagactttgtagaggtagttctcccaaactatattatgaaaccaaacatttttggtgcgctacctgctgatgggggctgccttcttactgcctagtatctacaaaatgtttggtctttgttaaagtttaacgatgacatttctgactaatatagagagacctgatttttttccaaatgtgttcagttgccataactttcaatgaatatgaaattttatcagtctcagaaaaacattaatacccatatttttatctaattgatttcactatttgttatgttaaggtgcttttgtgtataatttttgtatatatttttaaatgggatcaaactaagccataatttaaaagtcatcctaatgcagtaaataagataatttctctagtttgttaaattcttcagagaccgaatataattgctcgtttttctgtcatactccctgatgatgttccattgtggacttattttgcaaagttcccagatggcacaagtcaaaatatgaaatgctgatgattgattgattttatgtatcctttcatcttatgtaatttaatgtggaacagttattttgtagctctaaaatacatttgttaattaaccatattggcttttcatgcagttcaatggcttatagcatttcaatttgcatagaaaatgaatctctgtaatgatacttttgctaaataaataacaatcgacataatgggttcatttgcttttaacattttatacatacaatttagaagtaggatatatttcatattgaaattttgaaaagcttgaaattcaacatacaaggtcaccatcttgctgatgcctaatgcagtacagcaaattcattcttcatcccatgttaactcctttttggaacaagtcaaaatacaaataatttacaatgattgtgttggagctattgcttgattaaatacaattcaaaggttctttttataaaacaggtgtgagcaggacacattgcacttacgggcttttcctatttttttggttctatttcattttactgcctaggaaagaaacatttttttgtaaaacctatgctatggaactgaaatgtactttattgaatatttctattctgttttatgaatatcaattatgtgaaatatataaatataaaattgccttagaatgcctaactctttgtataaaacagatatctgaaagtagatgttggttttttgttcaaattgtgtaaatgctgatttttccatgagtacttatgaagatctatatgtaaaaattttaagtctgcttactgtgtttgtaccaccttgttcttagctgtgtatactctatgctaattgacttctgtcattgtcacatatattgcatatgtctctcaaaaattaaaaggtatattgctattctaaaaataaaaaatgtaaattcctga

SEQ ID NO: 15864 - DNA, 3996 bp, Homo sapiens
ctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacatta

SEQ ID NO: 15865 - DNA, 4619 bp, Homo sapiens
gtgcttcagaaaccaggagtttccgcctcggctcccccatgtccccttgtcatcccctgggtccccccagatcctcacccctccacacacactctcccgttcctagaggttccacctctgggctctctccttgccatttctttttcaaagatttccttagctgtcttctcctgagttcctggtccccttctcttcccttgcacccctccttcctatcgttccgatgggggcagtgccctgacttgggggcaggatccccggctaggctcttggggcctttctgggatgggatatttgggaagaccggtccggaatctaagaacccagaccctgtcccagtcctgtgcattcaggtgggcccgagggcgaggcgagatccagtgaggtccaggcctggtgcagccctagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataac

SEQ ID NO: 15866 - DNA, 4161 bp, Homo sapiens
cggagcggccggggcctggggctgcctgccgggcggccgggcgcggcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacag

SEQ ID NO: 15867 - DNA, 4355 bp, Homo sapiens
acttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 15868 - DNA, 7593 bp, Homo sapiens
gctgagcccgcagcctccggcagccgggaaagtgcgggcgcggggccgcagcctgcccgcccggagcggcccaggagcacgccgcggggagcgcgggcgtccggggctggagtcgcgcaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgtttttcgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctggaagaa

SEQ ID NO: 15869 - DNA, 3489 bp, Homo sapiens
gctgagcccgcagcctccggcagccgggaaagtgcgggcgcggggccgcagcctgcccgcccggagcggcccaggagcacgccgcggggagcgcgggcgtccggggctggagtcgcgcagggctccagtttgtgttttcagctgcctactagacctcactacctggatggcccacagctctggagactggaaggtccaagatcaagatactacagatttgatttctggacgttgaacatggtgtaggagtagaaaagcaacagggacggaaggagagaacttaccccttcaagcccttttataaggcactaaatcccatcattgagggcagagtcctcatagcctaatcacctcctaaatgctccatttcttaatattgttgcactgaggattaagcttcaacatgaattctgaagaggacacaaacatccaaaccatagcagtcaatgccttagcccttgatgttgctatcaacctgagattcggggatcaaggaaggacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctc

SEQ ID NO: 15870 - DNA, 7474 bp, Homo sapiens
ccctaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgtttttcgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctgg

SEQ ID NO: 15871 - DNA, 763 bp, Homo sapiens
agcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatcctcagagtgaaaacaccaacagtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactccta

SEQ ID NO: 15872 - DNA, 1957 bp, Homo sapiens
tccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctgacagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccatt

SEQ ID NO: 15873 - DNA, 7218 bp, Homo sapiens
gtccgcggccggggaggcggaggggaggagggcttgcggggctggggcgttagctgcgtcccggctggaagcccgcgaagagaagtaggaggaaggcgccgccgtggccgcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggtcatgcaagacaagataatctgccttccgaaaagagtgcagcctgctcagaaccactcttccctttcgaatgtctctcaagcagttgccagtaccactccactgcctccacctaaaccatctcctgctaaccccatcactgtggaaatgaaaggcctgaagacagatttggaccttcagcagtacagctttataaatcagatgtgttatgagcgagccctccactggtatgccaagtatttcccttaccttgtcctcatccataccctggtctttatgctctgcagtaacttttggttcaaattccctggttccagctccaaaatagaacatttcatctccattctggggaagtgttttgactctccttggaccacacgggctttatctgaagtgtctggggaggactcagaagaaaaggacaacaggaagaacaacatgaacaggtccaacaccatccaatctggtccagaagacagcctggtcaactctcagtctttaaagtccattcctgagaagtttgtagttgataaatccactgcaggggctctggataaaaaggaaggtgagcaggctaaggccttatttgagaaggtgaagaagttcaggctgcatgtggaagaaggtgatattctatatgccatgtatgttcgccagactgtacttaaagttatcaaattcctaatcatcattgcatataatagtgctctggtttccaaggtccagtttacagtggactgtaatgtggacattcaggacatgactggatataaaaacttttcttgcaatcataccatggcacacttgttctcaaaactgtccttttgctatctgtgctttgttagtatctatggattgacgtgcctttataccttatactggctgttctaccgttctctacgggaatattcctttgagtatgtccgtcaggagactggaattgatgatattccagatgtgaaaaatgactttgcttttatgcttcatatgatagatcagtatgaccctctctattccaagagatttgcagtgttcctgtctgaagtcagtgaaaacaaattaaagcagctgaacttaaataacgaatggactcctgataaactgaggcagaagctacagacaaatgcccataatcgactggaattgcctcttatcatgctctctggccttccagacactgtttttgaaatcacagagttgcaatctctaaaacttgaaatcattaagaacgtaatgataccagccaccattgcacagctagacaatcttcaagagctctctctgcaccagtgttctgtcaaaatccacagtgcggcgctctctttcctgaaggaaaacctcaaggtcttgagcgtcaagtttgatgacatgagggaactccccccctggatgtatgggctccgaaatctggaagagctgtacctagttggctctctaagtcatgatatttccagaaatgtcacccttgagtctctgcgggatctcaaaagccttaaaattctctctatcaaaagcaacgtttccaaaatccctcaggcagtggttgatgtttccagccatctccagaagatgtgcatacataatgatggcaccaagctggtgatgctcaacaacttaaagaagatgaccaatctgacagagctggagctggtccactgtgacctggagcgtattcctcatgctgtgttcagcctactcagcctccaggaattggacctgaaggaaaacaatctgaaatctatagaagaaatcgttagctttcagcacttaagaaagttgacagtgctaaaactgtggcataacagcatcacctacatcccagagcatataaagaaactcaccagcctggaacgcctgtcctttagtcacaataaaatagaggtgctgccttcccacctcttcctatgcaacaagatccgatacttggacttatcgtacaatgacattcgatttatcccccctgaaattggagttctacaaagtttacagtatttttccatcacatgtaacaaagtggaaagccttccagatgaactctacttctgcaagaaacttaaaactctgaagattggaaaaaacagcctatctgtactttcaccgaaaattggaaatttgctatttctttcctacttagatgtaaaaggtaatcactttgaaatcctccctcctgaactgggtgactgtcgggctctgaagcgagctggtttagttgtagaagatgctctgtttgaaactctgccttctgacgtccgggagcaaatgaaaacagaataacttatttttcgttaaagtttgactgaaacacgcttctaccaaatacagtataaataattaggtagtcttaatgcctttcctatttttttttccttttcacacaaaatgtacacaaagatcgcgtaaggagtatgtatttttaataaaaatttaattgtattttttcaatattaatattttgaagttttatttgtcttgaaacacaatgtatctattatctactgacagaaagagatagttccatttggttttttgtttttgttttttagttcattcttgtggaaaggagggaattataagttgcatgctttttggcattttttaaatagaggaagatattttgccaaggccatttttaacttgtttacacctgtacagggttcttatttttgttttcattgtgtgtgtatcaaggaatctgtgctagttattttaataccagctgtcttctccattggccaagaccttcattcagtggaacttcacataagtgcattgtcatagagtattttaaatgttcccctgcctccaacaaaaccctaaactgtgttatttcatatacctgacagttattgttatccttaggcaaggtttttgtgagtgaagaaaataatctttagtggctggtatgtttgaattaggcctttatcatttaacttatttgcattttaccaacattttaaaaatatttaaaacctaaatacagaggctcctcccaccttaatctcaatactgctatgtagtactggtgaacaactttggagaacctagatttattttaatattctaatagataattaaattttaaaatgatagaagcctggtttttgagtaatttaatcatctttcatatcttgatatgcagctgcatcagatggaaaaaaatttactaaagcaccctgttaaagagctggtgtgctccagtgaggccctctccttttctcagcacagtgtggcagtggtaatctattcaaattttgcctgttacacaaaataatccacttatatatacagtcagccttccgtacttgtgggttctgcatctgtggattccaccaactgtagatggaaaatactcaaaaagaaagttgtgtctgtactgaatatgtacagactttttccttgtcattattccctaaacaatacagcgtaacaactatttaaataggatttacattgttttaggtattataaattacctagagatgatttaaagtatatgggaggatgtgcataggttatatgcaatttctgcaccattttatgtcaaggattttgaacatcctcagattttggtgttcgagggcatcctggaatcaattccccatgataccgagggatgactggatattaatcgatttccctcaagcctgcccttgctgtgaactagtgctacaagcacgggaaatccatctgctctctggcttaaaatatgtatctcatctaaaattgttcgttaaagtgtgaataaattgctaagtggttgttgcttagcaataatttttgcctgaccatcagcagagcttttatttacctttgtaattaaaatccaacatagcatgggctcttgggcaaaatatttcactgactattaagcatgtagaacaggaaaatgaaatacactatttgtgcccttgacctagaaccagaaccactaattatgagaactttgttttatgtaccaaattcacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaatagtgttggaatcctgagtttgaataatgtgttgtatttagaaacatagccctatctgttttaaacaaataatttgttggccgattgtccatggttgagcatgacaaaaatacctcgtcgaaaggcaagcttaggtaactgctggcaaaacactgggtgcactatttttctggataaaatttatagttattttctatattacccttcaaaagggatctcttcaggttaaaaatcacgcttatgctgaagtctttatctggtgttaactaaaaatctcatatgggttcataaccgaggtcactaataattcatttttatcacttgtaaaaatttgctcaaaattccaaaaaaatattgatttgttttttagtgattttgcaggctgacccccaacctaagttttgataacatctggtaagtcagtatagttctgtgacttcatgttttaactaagaaggaaaattcatagatattcctattagattttataaaccttcaaaagtctgaaacttaattttgagtctaaattttctgacactggccccttttaatattgtaagtttttgttcactttcttaagtaaaaaaaacatttaattactagttagcccttaactgggaaactcaggtaatgaactgctgacttttctaaagttctttaactgatcaattctgtatagagggatatttatctaaccactttccgtattttacaagtgctctttctaaaaaggaataactattatagctctatttccccaatctctataggactcatgagagattgcttgtgtaaatataaaagcaccatatgtgttcttaactcctatggctgcttgaagctcatgatgaaaaagtctttttgtcagttttaattgttaagtacagaacaaacaattgtttggtgatggcctggttgaaagagagcatataaatatatcccagtggaactcaccaaagaagaccacacctcagaaattattgcattttctcattatgtgttgggtttgatttgcttttgtttttaatgcagctcttttaatataaagattcttgatacagtgaaatctcttatttcaagtgtaagttattcttcacccaccccttcccctgccattgtatttcccatctgtttcaaggagtttcaacaatttacattgcatcgtatgcagtaggtactgctttttcagaaagacctggaaaacatacctgctatgaatattttgttcagatgtagccatttacctggctctcaagttgtctttgtggagagggtcttagacaaaaatcttccttgtatttacttgggttaagtgaagtccaaattcttacagtatgctatttcaggatttctgatattaaaaaagaaaaaacaaaatctttatatctcttattaacacttcccccaagaagggttgtgctgttatttattttctattataagaaaagttcattctttaagtagtttcttttacctctaatctaatttcataccaaatacctgatcaatagaaatgatatatttaagcagcaaagattcctaatccatcattatgaaaagtgtcagcatacttagtagtgaacagataaagtcaatttgaatataattccactttgtttttagagactaaattaagattcaattaacattatcctatgaattctgaatgtgataatgtgattcaaacagtcaaattttattaagctcttagtaactcaggatagcattccatactaacctcaagttagcaaaacaaattagttaaacagcttggttcttagcagactgcttaaaagatcaagaaaattttctcatcttttctttctacttagaaacattgcaagaaaccttggacagtcttcaccagacctgccatgattttataagatttaggcctcagtgacatgctcctgaaagtttcctgccagccatccaaactaagcatccactcattccatcttcccaaagtcactcaccgataaaggtagcatccttaagttcatttttgaaaggtggaggaggatctccccctgcccaaaggaatttttttatcagaataccttgaaaggggggtatataaatttggaaaacttaatttcttggctgtgtttgataacagttcctatgcatggtttttaatgtgaggtaaatttgtttctttcttcagaatacctctctccaccccccaccttattcttcctctttaatgaatatttttattggagctcaaactccatgacttacgtgctcactaagttttcttttttccccttgtttactctgtctgtatgtatgtcaaaagctggcaaaacctctaaaactgtcaagaaaatgcttgaaagttgatttgtcatagtgcaaattcatgataaaatgtcttaatgttatttggatatgtagtacatagaaacagaaaaataaagtcatttttataacttaaaa

SEQ ID NO: 15874 - DNA, 3950 bp, Homo sapiens
aattcccctcgttacagagtcatgtgctgctgctcccgtcgccgctgctgccgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagtaacaagaaataacacatttcttaataatagcttttttgacatagtttggagttctgattatatggtacatttttctaccagtaatatagggttgccaataaatagaaaatgttttctaaaaataaattttattacaacaaaataaaaattttaatgacttattaacacaacctccagtatcaccaccatttggaagataacacagaatcacaagtatcatttaatttcttgcccttttcagtgttgttctggtgttggtgggaaaataataggaaatgtagttcattgggtagggaaactcttacctttccctatcttaat

SEQ ID NO: 15875 - DNA, 3345 bp, Homo sapiens
ataatccgcttctagcttgtttggaggcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 15876 - DNA, 666 bp, Homo sapiens
tcttttgagccagcgaggcacaagacaagtaatttcccatcttgaatctctcacagctgctgagctgtagtggatatactgggatgtggctatgaactttaaaaatttgcataaatccagcccctactcccctgcaaaggctcagtcttgtctttacaccttccccgaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcg

SEQ ID NO: 15877 - DNA, 905 bp, Homo sapiens
aaaagaaagctggattgccttaccaaatctccaggtttttcgttatacctcttcactcaggctctgcccagaactcaaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaat

SEQ ID NO: 15878 - DNA, 588 bp, Homo sapiens
ccatgttacgctttgtctaattcccctcgttacagagtcatgtgctgctgctcccgtcgccgctgctgccgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggagtccccgggccccaggctgcagactggtacctgtcgagagctgttaggaactgggcttcacggcagtaggaatgtttacccttgcggaagttgcatcacttaatgacattcagccaacttaccgaatcctgaaaccatggtgggatgtgtttatggattacct

SEQ ID NO: 15879 - DNA, 922 bp, Homo sapiens
agggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcc

SEQ ID NO: 15880 - DNA, 597 bp, Homo sapiens
acaatagccatgtgtgtcaggcagtgagctgaccagcaagtcctttgtgagtcttggaatgcattttccatgggtgggtggtgaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcact

SEQ ID NO: 15881 - DNA, 3600 bp, Homo sapiens
gactcaccctcgcggcccgcccgggaactctgcgggagtcgcggcagctccgctcccagagacccaggagttgggcccagcgtccctcccggaacggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtatccggggagaaccagaagggcccagcagccaccgaacgggctgcggccaccatagtggccatggcagggaccgggccggggaaggcaggggagggtgagaaggagaaagtgctggcggaaccggagaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctctgcatgctgccgggtctgcccgacaccgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccagctgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattgtcttccaagataggaagccaagtgggtccaggccaggagatggggggggcgggggcagctgtgtcatctttctggggcccaggaggatctgggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgccaaaaaaaaaaaaaatagggtatccaaatatctagattctgatcccttttgaggtcctagaccctttgagaaactgatgaagccaggcacctccttcctcaggaaaatgctggtgtacaaatacacacaaagctcttcaggcagctgatagatttcccccagagagctattcaaggacttcctaaggtgggtggactgcagggttaggacacctgctatagaggtgacatttttccaaggacaagcagggactttggtcttgactgttctctgggtgcttaataaataatactaattatgcaagttct

SEQ ID NO: 15882 - DNA, 2599 bp, Homo sapiens
actcagtgagcagtaggtgcctgtgcaagctcgcgccgcacactgcctggtggagggaaggagcccgggcgccgctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacagtt

SEQ ID NO: 15883 - DNA, 2126 bp, Homo sapiens
agatccgccggccgcggaccggggctgcctcggaaacacagaggggtcttctctcgccctgcatataattagcctgcacacaaagggagcagctgaatggaggttgtcactctctggaaaagggtggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacag

SEQ ID NO: 15884 - DNA, 578 bp, Homo sapiens
cttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaagggtggctttctgcatgcttagagatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgccttt

SEQ ID NO: 15885 - DNA, 879 bp, Homo sapiens
ccgctctctgcagctgcccggggcgcgaatggcaggctgtttccgcggagtaaaaggtggcgccgcatctaacatggaccaaatcaccatctctttgatctttccgtggctgtgaactttctatgctgcccagctttctgcatgcttagagatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaag

SEQ ID NO: 15886 - DNA, 3014 bp, Homo sapiens
aagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaagttctgtcaacagattcagtccccagtcctccttctctgagcagacctctcatccgcagcatatatctgctagatcttctaagagctgaaatggagacttctggaagaaggtgggaaagaaatccatctcggcttaattaaccatttatcgcatcatattactcccatcttaaaagtgcacgcgttgtttttctgaaccctcacacaaaggctactactgtggtcccatatctgtcggcccatgagaaacagtgttcttggacctcacagccaagcagcactgaactgcagcaaaatccagcaacacattcagcagcgagcagcctgctgagctccactggtttatccggggccaccaaccccaaagaactgggatgaaagcagatgtgagagaggaaaaggatctgtttttgttttattttctaccaggcccagctctttgtggggggaataaaaaagaagaaaaatcgagctccaagctggtgccctgccaagcttcctcccctcccttcctagtccaagcactccaccgtctgtgcagactgcataacagcaatttctggaaacaggctgaagaatctgggccagtccagaggcagtggattcctggtttatgtgtggtggggtttttaggaattttatttttcaccttaattctttcaacaactgccagctgtttgaagcacatctgtaataaacagcttctgtttgtaaaatgagactgaagttatcctctccagagaaattcctgaatcttctctgtagttcaatgccttcactgacagtttggctcaaaaagtatgagtgtggtaaatattaaagaatgttaatacaagtgt

SEQ ID NO: 15887 - DNA, 4023 bp, Homo sapiens
cctgtgcaagctcgcgccgcacactgcctggtggagggaaggagcccgggcgccgctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattaatctttaagcttcaagaaacttgctctgacccctctaagcaaactactaagcatttaaaagagaatctaatttttaaaggtgtagcaccttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 15888 - DNA, 765 bp, Homo sapiens
acgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactg

SEQ ID NO: 15889 - DNA, 2216 bp, Homo sapiens
tgctgctccaggagctcttctctgcaacaagccacccatctgccatcaacaagttaagaccaagagaactaacggctgcggaaaggagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatgggcttacatttcaagtggccattaggggcccctatgctggcagcaatatatgcaatgagtatggttttaaaaatgctgcctgccctgggtatggcgtgtccacccaaatgccgctgcgagaagctgctcttctactgcgactctcagggcttccactcagtgccaaacgccacagacaagggctctctgggcctgtccctgaggcacaatcacatcacagagctcgaaagagatcaatttgccagcttcagtcaacttacttggctccacttagatcacaatcaaatttcaacagtaaaagaagatgcttttcaaggactatataaacttaaggaattaatcttaagttccaacaaaatattttacttgccaaacacaacttttacccaactgattaacctgcaaaatttggacctgtcttttaatcagctgtcatctctgcacccagagctcttctatggccttcggaagctgcagaccttgcatttacgttccaactccctgcggactatcccagtacgcctgttctgggactgtcgtagtctggagtttctggatttgagcacaaatcgtttgcgaagtttggctcgcaatggatttgcaggattaattaaactgagagagcttcacctagagcacaaccagctgacgaagattaattttgctcatttcctacggctaagcagtctgcacacgctcttcttacaatggaacaaaatcagcaacttgacatgtgggatggagtggacctggggcactttagaaaagctagacctgactggaaatgaaatcaaagccatcgacttgacagtgtttgaaacgatgcccaatcttaaaatactcctcatggataacaacaagttaaacagccttgattccaagatcttaaactccctgagatccctcacaaccgttggtctctctggcaatctgtgggaatgcagcgcccgaatatgtgctctggcctcctggctgggcagtttccaaggtcggtgggaacactccatcctatgccacagtcctgaccacacccaaggagaggatattctagatgcagtccatggatttcagctctgctggaatttgtcaaccactgtcactgtcatggctacaacttatagagatccaaccactgaatatacaaaaagaataagctcatcaagttaccatgtgggagacaaagaaatcccaactactgcaggcatagcagttactaccgaggaacactttcctgaaccagacaatgccatcttcactcagcgggtaattacgggaacaatggctttattgttttctttcttttttattatttttatagtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaattttttaaatgaaaccatattttaagtgttaaatgaatcaatgctcacattaatttgcactcctgttggaaagtctaaaatgcttacttcaaaataagaaatgtatgtaattatatacaatcgtgtgtaaacct

SEQ ID NO: 15890 - DNA, 3192 bp, Homo sapiens
acataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaaca

SEQ ID NO: 15891 - DNA, 3530 bp, Homo sapiens
aacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaa

SEQ ID NO: 15892 - DNA, 3616 bp, Homo sapiens
agtgtatcacaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttctttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcttttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttcagacaaagcactgaatttgaaataatctctaactcagtacaatttggactattgaactgttcttcaaagaattcattttcttcttttttgtgtatcattgaaaataagagaagtaatcccagataataaattcctaaaaggaaactgtataagcaattgcccttaaaaattaaaaagaataaaagattttctat

SEQ ID NO: 15893 - DNA, 2247 bp, Homo sapiens
acaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaag

SEQ ID NO: 15894 - DNA, 2227 bp, Homo sapiens
aaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaa

SEQ ID NO: 15895 - DNA, 2976 bp, Homo sapiens
ctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaagagaaaaaaaaactgcttgaagagggcagcgaatgcacctgcagcattaccgggaggactgcagaactttctttgctttaaaacataaaacaaacaaaaatgctcccggatgtaaatagtaagagtgtcaagttcttataaaaatagatttcaccctagctacatataggtttgtttgtatatttgatttttctacactgcatggttcctgggctggagaaccacaggggagcaaataaacaggggtgggtgggaagctagggaaacaaccgttttcctctttaggtgtgtgtaattctcacagattttatttaaattgctttcatttattttttctttaaaaatgctgtttgttcttgttttgtttgttttaatttttttctttcctggtcaagtttctaatacaaaacatgagcattaaagcttatgttgtaccaaaagaaaatgtgctttaccacggaccacggagaaagttgaccacaaagtttgacaaaactactggaaaacccaataagtctgggtgaatgacccttcatgacaaatgccatatatggtacatgatagaaggaattttgttttgtcccattggcagccctcactgtgtaggatgcctgagagagccatgaagatctccgaatgagaagaccagcagaatcattctcatgtggactaaggctataagagagatatgaccatgggctcaatgaatgaaactgccaagctgacaaatttctaaacacaagataatgtgtaacattgctttttaaattaattatcaattagcttttgtgtagtttttatcaataaaagaaaaaatattgaaaaataaatata

SEQ ID NO: 15896 - DNA, 2332 bp, Homo sapiens
agagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 15897 - DNA, 3601 bp, Homo sapiens
ctttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaa

SEQ ID NO: 15898 - DNA, 2402 bp, Homo sapiens
ccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggtaagtgccctgcccctggaggtagcgtctagctgggctcccctaaaggaaaggaggaggagaaacaagaaatctacgaccattcttctgccatgcttggacctgggaagggagtaacagacctctaagcattccttgctctcagtcaggataaacctaatctttcccaaactatgctcaagtccctccattccttgcagtcagggaagacaacagcaactagtggagggggaaggggattctggtgggggtgctggcccccagcctaagtcttccccacaggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 15899 - DNA, 3705 bp, Homo sapiens
ctttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaaata

SEQ ID NO: 15900 - DNA, 3822 bp, Homo sapiens
ctttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaa

SEQ ID NO: 15901 - DNA, 983 bp, Homo sapiens
agagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgctt

SEQ ID NO: 15902 - DNA, 842 bp, Homo sapiens
tttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgactt

SEQ ID NO: 15903 - DNA, 814 bp, Homo sapiens
gaggcagtgggacgccaagactggagaggaagcgactgcgggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttaca

SEQ ID NO: 15904 - DNA, 726 bp, Homo sapiens
aacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 15905 - DNA, 527 bp, Homo sapiens
ctatattccaagcagacagagctggaaggagacactgttccacttagaggcccagtggcaggtgcagggaacttatgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacct

SEQ ID NO: 15906 - DNA, 1270 bp, Homo sapiens
agcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagct

SEQ ID NO: 15907 - DNA, 8898 bp, Homo sapiens
gagagcgcgcccggcaccggcggcttcccaggcccgcggccggctggcggcgcggagctgtcactgcggcaaacggcgaacgcgccggccccctcccccgccgcccgcaagcctggtgcagtcggcccatgagtatttcatgaagtgccgcagccggattcatggctcactggcgcaggaggggagagaggctgagtcctgtcaagcgccagcgccccacccgtcacggagcgcacgccgcgggggccaggctggggagggaagggtgtccagccctctcttttgggtggtgagatgctgaggcctgagggtttctagggcgcctagcacaggacccagctacggaggcaataaaaacttggtggagtctaagtcctgggaagggaaaaaaaggacggagggggcggggcctacagacaaccccgcccatcacaaagaccccgccttccagaacgctgacgtcacaatttggccccgcccctcattgtcagtcccgcggagccagaggaggcgccggtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaa

SEQ ID NO: 15908 - DNA, 3715 bp, Homo sapiens
agctgagcggcggaacccttcgctggcgggagcgcggttcggggccgcagagattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatgagcagctaaaggagctccccgtaggccctcagaacagcatgaaaagcacaagaagcagctgcagctgatggggagctctgggcaacaggaggaggcccggtgccctttctgtagggcacagtgagggggagccaggtcagcaagttctcggccgcctcagttagcagatcttcacaggctgctggcctctcagggatgaggagagccggggcttacactgggcctattttagataagcgtatacccaattccaagtgacactttcttttgccccccagacagctgtctgtctcatattatcagtctgagggcagggctggttcagtatagctcattacagctttgataaatccagaaccacctgccttatgtgagtgtgaggctcagggtgtcagaacagcatctggagaagcccctgggagtgtctttttgatgagaaacctgtgatgatgaaaaacttcttggacctgga

SEQ ID NO: 15909 - DNA, 8331 bp, Homo sapiens
caggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaaggctcag

SEQ ID NO: 15910 - DNA, 8502 bp, Homo sapiens
ttgtcagtcccgcggagccagaggaggcgccggtcgctggcagctgagcggcggaacccttcgctggcgggagcgcggttcggggccgcagaggggacagccctctgggtcacctcagtcttggtatgattcatgcattacctatctcttccattctgtttatattctatccaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaaggctcag

SEQ ID NO: 15911 - DNA, 1190 bp, Homo sapiens
ggagccagaggaggcgccggtcgctggcagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaac

SEQ ID NO: 15912 - DNA, 613 bp, Homo sapiens
gtgatcctcccgcctcagcctcccaagaagctgggatgacaagtgtgtgccaccatgcctggctaatttttgtatttttagtagaaacagggtttcaccattttggccaggctgttctcaaactcctgacttcaagtcatccactcgcctcggccttccagagtgctgggattacaggcatgagccactgcgcccagtctgtctcattgttgatggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaa

SEQ ID NO: 15913 - DNA, 3553 bp, Homo sapiens
agcgacaggatcccgaagagagagagagaaggcagcgagggaaggaggaccccggcaggcagcagcatgaaattcagcccagcgcactacctgctgcctctcctgcctgcgctggtcctcagcaccagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttgg

SEQ ID NO: 15914 - DNA, 5016 bp, Homo sapiens
agcgagggaaggaggaccccggcaggcagcagcatgaaattcagcccagcgcactacctgctgcctctcctgcctgcgctggtcctcagcaccaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgcattttatttatctcaatttttatttgcttcaaaatagaatcggataagtttaaaatgttcctcttacatttgtgaatgtgtctatgagagaggggccatttctcacatattttaattaacaactaaataaacagacgttgttttaaaggaattaacacttaaatcccaaccatcctcatatagaataaaatatcaacctaaatctttactatagatagtataattctattatgtacctgtaatgataagcattgaaagattatttacattttgaaaaacatggaattgattcttattaagaaaaaagatattttccaatggagtaacttgttttaatagaggtacaaccagaaccaacaattgtatttctctatagttattttaaaatagtaatcaatgctatgtatttgatgtatatgtttctaaattagaaatttcttttggctttgtgtttttttaatgtgcgttaaatatgtaaactgaacctgttcctaaaatgcattaaacttgaatgctgtgtctatccaatgccaaaatgctcagaagaaaagtgaataattcagtcattcatctggatgtagttttctgtgtaatctcaaatatctgaatattgaaaaaactaggttgctaacttttttcattccttatgcaaatgtttagcatcatagtgctgtttcagatacagatctgtttcatcaaatatcctcaattacaagtctaagacagttatatgtaaagaaaatgtattattttagatgaacaatgtggataactgaactaaaacgatatttgtgaactttgctataatgaaatcttttatttttatagctcaggtattgtaattagcactaattgcagcagagactgaaataattattgacaccgtagagtaccatagagtaggttgaactggccagacctagacaatgaagaaaacacatactgtttacttaggagacattttcttagtcgtgtgtatagtcctaaatttccccaaactatgtgttcatttggattgtgttatataataacagtcgaatgatgaagaataaaagatgctgaaagatg

SEQ ID NO: 15915 - DNA, 4073 bp, Homo sapiens
gaaaatgcataattgcagtccacgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaatactgccctaccttgactgtgtaatcttatttgataaagcctttgctattcattatttccattctgattaactgaaagagatttatagagatgctcaaattttaagcccttggtgcttttagatatatattggttgcaaaagtttggcattaatgatttccctctgcttatgtgtaaatgcctatgttccaaagctttgccactagatattcaaatcataaattgtcatgtaagccagtcttccagaaagaaaagctatttcagcaaaatgatatttcacatttagacaaaacagtagtatttagacaataatattttgacaaaaccattttcaaaactgcttaggaaaaaggggaaatattatacttaaaggtaatgacctctgtcttgaatagaggtgagtgggttggtgacaactggtttggaggcttttgtgggggactgtggtgtcttttggattgtgtcatcagctccttcatcaagtaagcgtgtagctgttattgcctattgtaaaacatgaattgatgtgaacagtactcaatctcttacattatatgaagtataacttcctctcttttttgcctataatacatcctttaacttttacagattaaaaaaccactgttagacaaagcaaaa

SEQ ID NO: 15916 - DNA, 2014 bp, Homo sapiens
acacacatctgaagagcaaacagatggtgaaaccagtagcccaagatgagaaaacggactttttttgagacagcagttgaagctgaagcctcaaaagccgggcggggggaaagcatagcaattatgaaagacattcaaagtgggttaggggtgagggaaaggtcagccttttacttttcccacacccgctgttttctgaagaaggatggtaatgcgagcagaagggtgatggccaacctctgggctttgatgtgtgtcccctcctcccgcccccatcctgcaagctctggggaggtcggagactagtgtggtttcctcacacctcccaccatgctggcactgaggttatctaagagttgacagccccatctaaagccttgaatgaattaagtcttttttagctaaaaaatgaacaaaacctgagatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagct

SEQ ID NO: 15917 - DNA, 1272 bp, Homo sapiens
agatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaagatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttaca

SEQ ID NO: 15918 - DNA, 1370 bp, Homo sapiens
ctggccaccaagcgcctccgtggacacgcacttcctgcgaggcctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccatagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcact

SEQ ID NO: 15919 - DNA, 5462 bp, Homo sapiens
gaaccggtagtccgcggtggcgcggtccgcccctcacctggccagcggcgggcgctgaggggcccaatgggagccgcggcctggccgccccgccccgcgcctccggacgtctgtgccgggacaaggccgccgctggtgccgggtccttgaggagagcgcctcccgtccgaggccagccgcctctgtcagccgtccgcgcgggccgggtctgaagcgccgccgggacggcgaagagccgcggccgccgcggagaaggaggcagcgcaggaggccggagcggccgccgcgcccgagcacatggcgtccatcttactgaggagctgccgcggccgggcgcccgcccgcctcccgccgccgcctcggtacaccgtcccgcggggtagtccaggggatcctgctcatctcagctgtgccagcaccctggggttgaggaactgcctgaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaagctgattgctgaggaaggggtggacagcctgaatgtcaaggagctgcaggcagcgtgtcgggcacgaggcatgcgggccctgggcgtcacggaagaccgcctgaggggtcagctgaagcagtggctggacctgcacctgcatcaggagatccccacatcgctgctcatcctgtcccgggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaagtacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccacggagattcagtctgtctggaatcccggaacccctccacagaatcgtgtctggatccacactgtggtgtggctgccacggcctcctggctccagaggcagctgggctgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgcacactttcagttggatgtgggtcattgtggagacagaggtgtctgccatctctgtggcctctggagagtgacgtctccctgctgggagtgctggttctcacgtgcggtttcccttgtgtatcggagctctttctcggctttctatttcccccagttctttaagcagtcaattggcacagagtttcccacgggggctgcagtggattcactgtgtcagggatgagcctggcttgggggttggtggggctctgaagcgcatttggggttctttgtagcttctaatgtgaggtttgagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccagggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcacttttttttttttttttttttttttttgatacagagtctcgctctgtcacccaggctggagtgcagtggtgcgatctcggctcactgcaagctccacctcccgggttcaagcgattcttctgcctcagcctcctgagtaattgggattacaggcatgcgccaccatgcccagctaatttttttttttttttttgagacagagtcttgctctgtctcccaggctggagtgcaatggcgtgatctcggctcactgccagctccgcttcctgggttcacgccattctcctgcctcagcctcccgagtagccaggactacaagcacccgccaccacacctggctaatttttttgtatttttattagagacagtgttttaccgtgttagccaggatggtctcgatctcctgacttcgtgatctactcacctcggcctcccaaagtgctgggattacgggcaagtttttattagagatggggtttcatcatgttggtcaggctggtcttcaactcctgacctcaggtgatccacccgcctcagcctcccaaagtgctgggattacaggcatgagccaccgcgcccggcctgaactctcagttctaacgcagggattcaggaattgggctttcagactccttctgcagtgtcacagtccagactttttttaaatgaaggacaccccgcagtggctcacagtgggtcccagggctagcaggagcgtgctggggagccggctctgtctttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaa

SEQ ID NO: 15920 - DNA, 2227 bp, Homo sapiens
atgcgacacacatggccttttaggaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaagctgattgctgaggaaggggtggacagcctgaatgtcaaggagctgcaggcagcgtgtcgggcacgaggcatgcgggccctgggcgtcacggaagaccgcctgaggggtcagctgaagcagtggctggacctgcacctgcatcaggagatccccacatcgctgctcatcctgtcccgggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaagtacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttcc

SEQ ID NO: 15921 - DNA, 6335 bp, Homo sapiens
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatctttttttttttttttttttttgagatagtcttgctctgttgcttaagccagagtgcagtggcgcaatctcagctcactgcaacctccgcctcctgggttcaagtgattcttgtgcctcagcctcccacgtagctgagattacaggcttgcaccaccatgttcagctaatttttgtatggtaaagacggagtttcaccatgttggccaggttggtctcgaactcctggccccaagtgatcctccccctgcgctcgcttcagcctcccaaagtgctgggattacaggtgtgagccaccacgcctggccaagagcctcactcctgtctttagtgattgcactgaagcaggcctcatttttttgcagtcatgctaaccacaagttagtcaacattcactaattgacattcattagaataggtctccaaggtgaggcataacgttggggtgtaatctggatttcgcagtcatctttttggggaaactgaaagtaccatctcatttgcatgaagtgactccacactggccctgtatatggactctggtaaaatgtgagtgtggtacagaggaaataggtaagacccccttatctagccctctcggcagcagcgggggggtgttacaaaggactagctgttcaaatatcttttgtattgtattg

SEQ ID NO: 15922 - DNA, 6422 bp, Homo sapiens
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccgggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatctttttttttttttttttttttgagatagtcttgctctgttgcttaagccagagtgcagtggcgcaatctcagctcactgcaacctccgcctcctgggttcaagtgattcttgtgcctcagcctcccacgtagctgagattacaggcttgcaccaccatgttcagctaatttttgtatggtaaagacggagtttcaccatgttggccaggttggtctcgaactcctggccccaagtgatcctccccctgcgctcgcttcagcctcccaaagtgctgggattacaggtgtgagccaccacgcctggccaagagcctcactcctgtctttagtgattgcactgaagcaggcctcatttttttgcagtcatgctaaccacaagttagtcaacattcactaattgacattcattagaataggtctccaaggtgaggcataacgttggggtgtaatctggatttcgcagtcatctttttggggaaactgaaagtaccatctcatttgcatgaagtgactccacactggccctgtatatggactctggtaaaatgtgagtgtggtacagaggaaataggtaagacccccttatctagccctctcggcagcagcgggggggtgttacaaaggactagctgttcaaatatcttttgtattgtattgattcccctattgaatataaatatttaaagtataataactatactgtaggtgggcttatgagtgttctaaatatctaatagctaaattgaaataagtagaaatataaacaatttagcagctttctgtaatacatttacactcaaattataagcagctaattctaaaaaagatgtcactgtaaactattgagaactatagtattttatatataattatatgttcatgtatttgaacccaaaataattttaactgaaatgctttgaataaagtatactgtaaatatc

SEQ ID NO: 15923 - DNA, 5206 bp, Homo sapiens
ccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcgtgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgaattataataacttgggggaatttcctcaggctattaaagcccttcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcagtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaaactatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaa

SEQ ID NO: 15924 - DNA, 4611 bp, Homo sapiens
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaa

SEQ ID NO: 15925 - DNA, 2822 bp, Homo sapiens
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcga

SEQ ID NO: 15926 - DNA, 2664 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 15927 - DNA, 2800 bp, Homo sapiens
ctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcgg

SEQ ID NO: 15928 - DNA, 3406 bp, Homo sapiens
gaacgcttgtgtctaactgatgctcctaatgcggaagcccctgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 15929 - DNA, 3096 bp, Homo sapiens
gaacgcttgtgtctaactgatgctcctaatgcggaagcccctgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctagacctgaattataacaagctgcaggagttccctgtggccatccggaccctgggcagactgcaggaactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaag

SEQ ID NO: 15930 - DNA, 3567 bp, Homo sapiens
gcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 15931 - DNA, 546 bp, Homo sapiens
cctgcccctctctgactgcaccgtcccggcgctcccaccgccgccgccgccgcccaatagagcccctggggcggtccccaccgacggtgcagcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctagcagtgcccgggatggtggctgagggtaaagctgacagaactggaggtggaggaagtagcaggccagagaagactcgaagatccttagaagaagccatagacagaactataggaggcgcccaggagctatgggctccagaagtttcctcttaa

SEQ ID NO: 15932 - DNA, 2487 bp, Homo sapiens
atgcgcttggagggagagggccgctcagcgagggcgggacagaacctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaa

SEQ ID NO: 15933 - DNA, 7701 bp, Homo sapiens
gctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagccattgacacccaaacaaacagagtgggaacaaacagcacccttcagtggcactttccctttgtcctgccatctcctgccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacg

SEQ ID NO: 15934 - DNA, 7671 bp, Homo sapiens
gcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaa

SEQ ID NO: 15935 - DNA, 6271 bp, Homo sapiens
gctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatgggattatgccagtctcctctgtgaaggtatgctgggcagggtggcctgtccgggacatggtctacatggttgcagtgatgtga

SEQ ID NO: 15936 - DNA, 569 bp, Homo sapiens
gcgtctgggcccggccccggcgcggggggcagacggcggtgggacggccaggccccggccccgccagtgtgtccgcccggccccgcgtcccggagcgcccgcacccggccccgccgccgcctcaggtggtctctggctggcgcagatacaactgctctgtctaccatggtctctgcaagctacaggggaccttcctggcaggcagggacgcgggaaggaagcctaggaaggccggggtcagcgaggagacgctggtggagaatctgagaacccccgtggccatctcaacctaccccttcacagtatgaggccgcgaagtttttctcccacgaacacttcccctgcaacagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacg

SEQ ID NO: 15937 - DNA, 3112 bp, Homo sapiens
cgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcgtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaag

SEQ ID NO: 15938 - DNA, 9158 bp, Homo sapiens
ttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactt

SEQ ID NO: 15939 - DNA, 2950 bp, Homo sapiens
attcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttcccccccgctttttgatgaggaagaagacaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagag

SEQ ID NO: 15940 - DNA, 6428 bp, Homo sapiens
gagtgggggtggcggccagcatgctgctcggctgcggctcggcctcccacacccgcggctccctagtcctcgccagcagcggcggcggcagagcagcgagcggcgcccgcgtctgcagcggcgccgggtccgagcgcgcggcgcggcggtgggggtcggggcccgggcggggagcggggaccgggcatggcgctgcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttcccccccgctttttgatgaggaagaagacaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgttacatcagcactcttgggtacattctgggactgtaggctgaggcttctagcctcagaaaccacggattttaatgaacgaactcacccacgcatagtagtgttgttacttgaaacttctgcaaaataccaagcaaacaggagaaaagtggtttgttttcatttttaagtgcaaattacttttcttctgcacttttttttccctcttggtttctttgaacaggctacaaatgcccaggtccccccattggaggctgaaagggaaagagctttgccattcctccagtcctaaagatggcaagctattctttctgttgcatggaaccactcagataaacctgggcagaaaaatgggtacttggcaaactgtaggagatatttagacagtcccagcaactatgccagatcaaagtgatgttcccaattccagccacctgtagagatggcaaggtggcatcttttcacagtgttgctactgcagagaggtatcacattcccagctgcccctctgagggtaaatgagcgactgaccccctgcactcactattctgctcacattgccagattctgggaaaccaggaaacacaggatgctgggcttaggatggggagagctgttgagtccagatggggaattaggaggtgaaagaacgatctaaacaggtgatgggtggggtgtgagaagggggtgacccactcaactgcaatcaggttttccttttttataatgttattttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtaataatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaactttgtggcgaggctcctggactgatccctctgtgcggccatgtggctttaaggcctttccttaaagggggcttgtccccatactccatggggtcgggaatgggtctattatcaagactctaaaaataactcttagacatgaagagcactgtgttattggacagtggatgataaggccaccttacatttagcaaagctttatatttttccaatgcacattagtactcacctcatttgttcataaatagctctgaagtttattgcagggcaggtattattctaatttcagagagaaggaaatagacatgaaaactatatgaattgcctgccatggttatccaatagggactggcaaagcaataactttccctctgatcagcagacattgtattttctttctaagacaccctgctatactctcccagagaaagactttcatttctagcatgattttgaatttggcagcaccttgagataaagtaaaaagtgcaataaaatatgcatagccagaagaaaaatcatactgaatagacaccattcaatcaactggtccatttaacaattaacaaacatgcaattgcatgccccactctttttacattcaaggccccactcttgaaagtggtccagaaattttggatagttttctgttgtactaaggaggatatctagctggtctggttgtttctccccctgcatagctatggggaggatgttgaggttgagacacatctggttcttgtcacattgtccaccagataaacaagaagagatctgtgaaggaaaaattcaaaacctgaatgcacgagtggtgatgaattgctctcggccgtcatcagccttcaggaagcacactggaaatggcagagttgcattttttcttccccatggagtgagagtctgtgtatttttaggaaagaaatcagcatgggatgccagaggtttggcggtcaggagtgctcatgatggaaatttctctggcctggggtataatgaaggtgagatgaagatctgcaggaggggagtctatttgcatgccacctaaagaaaacctcttaagctggcttcctgattcttctgcagaggtatcagcctctccttcgcagctgcggaaggaagttctttaattaggcagcggccaaagattctgttcaacagcttcctggagtggaatacaataatctagttgtatgcaatgatgcaattagaaagtggtccggatttgggtggcaatggaaggggaatggcaaagtggggcagatggctctggaggaaacttgggaaagtaaaaacaaactgaaagaaaaggaaaaaaggatgatgatttcttttgcctcagccaggcaagcagagggtagaatgaccaggaagattaacaacatctcaattattaatgaagagagccaactgtaatgctcattcaaataagaagcatattgtaaagctactgagatcgaaaccaagttattattatccttactgtattccattgcttgtatcaaaatctactttttttctagtaggaaactatgcattccctatcagtccctttgattatcaggaatgtataagaattgtgataaaataggccaatatgctatttggtaccatttgtatgtattttaagtgcataacctaggtaaaataagaatagtttctatgtgtaaagaagcaagttttacagtatgcagactacagtggatgtattttaggctgtatacatatttagctctttttggtaaatagggtatacaaactatatgcctcttaattcaatatattcggtaagcctatgaataaaaagtggttcatgcctaa

SEQ ID NO: 15941 - DNA, 3272 bp, Homo sapiens
gcgcgcgcccccgccgcccgcgccgcagtccgcagccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtggggcctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaccggc

SEQ ID NO: 15942 - DNA, 2814 bp, Homo sapiens
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 15943 - DNA, 2891 bp, Homo sapiens
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccggtgagccccctccccgtccttctgcctgtccagcagcctgcctggctggcctgacctgcctccccacctccccacagcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 15944 - DNA, 2891 bp, Homo sapiens
agtcccttcccccaaggccgaccttctcatggcctctgaccccctcctccttcccatcctactctgccgggtgtgccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 15945 - DNA, 3245 bp, Homo sapiens
ccgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcgttatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttg

SEQ ID NO: 15946 - DNA, 4131 bp, Homo sapiens
cttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 15947 - DNA, 3314 bp, Homo sapiens
acaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagacccagccctcattcttcctcctatctccttcaacacacttacacaggcacagacatgggacagctctagctacagtgttccatctgaaggagacagtgacaatgtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtga

SEQ ID NO: 15948 - DNA, 5273 bp, Homo sapiens
gctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 15949 - DNA, 4456 bp, Homo sapiens
aacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtc

SEQ ID NO: 15950 - DNA, 5283 bp, Homo sapiens
gattgttcggctgcgaggtcggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctccttttattagagccatcccagtctgctggctgcagctccccgtcccagccccatatgtctgctgggggaaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 15951 - DNA, 4497 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaactta

SEQ ID NO: 15952 - DNA, 1471 bp, Homo sapiens
gatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttca

SEQ ID NO: 15953 - DNA, 2290 bp, Homo sapiens
gtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcata

SEQ ID NO: 15954 - DNA, 2222 bp, Homo sapiens
gaaagcagaaagctgtttattttctgtgacatcacttcactttgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcata

SEQ ID NO: 15955 - DNA, 4572 bp, Homo sapiens
ggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttac

SEQ ID NO: 15956 - DNA, 2625 bp, Homo sapiens
aagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatggggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtc

SEQ ID NO: 15957 - DNA, 4223 bp, Homo sapiens
caggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgtacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctga

SEQ ID NO: 15958 - DNA, 12752 bp, Homo sapiens
tccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccgacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttacatggatatatgaagaaaattgaggttcagcctgtagcagctctcctcttctgcccttcccttagattgtctgtgtgggcaggtgtctaagagagtagttgattagcttcagggattctttggtgggtgttggggtatatacttttgtatatgtatgtacatatttttatttctttattatagtgtttcattgggtacccggtccttcacttggatgtgtaggttcctaatgagccatggagttatggatgtataacaatctgttctccctttacccttttaatgtatatgggcaataattttaaagtagtttggatttttttaagttttgaggggtgggaggggtctaaggcagaatatatcctttttaaaaatgtatatatacttttcattaactatattgtattatttcatgctgtacccagtccattgcttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaca

SEQ ID NO: 15959 - DNA, 3888 bp, Homo sapiens
gctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactga

SEQ ID NO: 15960 - DNA, 3769 bp, Homo sapiens
gaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 15961 - DNA, 647 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctaagctggatcttctaaataccagtggggcattatga

SEQ ID NO: 15962 - DNA, 4766 bp, Homo sapiens
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgact

SEQ ID NO: 15963 - DNA, 3737 bp, Homo sapiens
aggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcgcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 15964 - DNA, 2652 bp, Homo sapiens
gattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgact

SEQ ID NO: 15965 - DNA, 2213 bp, Homo sapiens
cgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaaga

SEQ ID NO: 15966 - DNA, 3766 bp, Homo sapiens
agtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctag

SEQ ID NO: 15967 - DNA, 4281 bp, Homo sapiens
gttgctctcctcccttccccggtcccgcccccgtctgtctgtgtcgactgcggacgctatcgataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatga

SEQ ID NO: 15968 - DNA, 2800 bp, Homo sapiens
atcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctg

SEQ ID NO: 15969 - DNA, 4744 bp, Homo sapiens
gctatcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatgacttcaggacatatgtgtgatcctggaatacaccatattccaatttcagagttaattacaaacagattgaggtattccatcatcatcggaagcattggctgtgtgtctgactccacatggaatgctataaagtgggatacatgtggttcttcttgttccagaacttacagtccatggtagacaacactgatacaggcaaactagcaacagcaattaagtcactggttctcagacttaatactctgcctggtcctcatgcccagatattccaatttaattggtccatggtgtggcttgaacaccaggaatctttaaaactccacaagtgattctaatgggcagcaaagtttgagaatcactggacacattgatgcacttgagccatcatttctatctagttcttcctcttcctaatcttcaggttagcggggataagtttggtccaggaccaagagttggaccaaaagggaagacaggggccagaagtctagagtgctagagccgacttgaatgtactcagtctcattgcacatggcagtgaatatggattaaatataagcccatgaaaatatttggtacaaggaa

SEQ ID NO: 15970 - DNA, 566 bp, Homo sapiens
agtgctcgcctaaaggtggagaacgaggagtagaggagccgcaggccagagcctgtgagcaggtcgttttcacgttagggctcggaggtcctcagaaagatgaggttccagacgagaaatccgcctgaggtcacagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttcc

SEQ ID NO: 15971 - DNA, 3969 bp, Homo sapiens
cttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggccttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccccccatcccctactgtgacttgctttagggtgtcagggtccaggctgcaggggctgggccaatttgtggagaggccgggtgcctttctgtcttgattccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagatgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggc

SEQ ID NO: 15972 - DNA, 10089 bp, Homo sapiens
aatcctaaccctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatcccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatctta

SEQ ID NO: 15973 - DNA, 4253 bp, Homo sapiens
agtcccggctggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctc

SEQ ID NO: 15974 - DNA, 760 bp, Homo sapiens
ggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgtgatcggagcagctatttcctcttcaagaattgaattgagacttctttgctttgtaataggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcac

SEQ ID NO: 15975 - DNA, 574 bp, Homo sapiens
caaacgcgtccggcatacagcgtaaacatcttcagaccgtgattctgcgccatcaaacgctctccagctaatttcatttggtgattactctgctagaaaaccgaggccaagtgaaactgcggaaatgggaacaatgtacggaggaaaaatctcaccccattaagagatccgtttcttctccgcacaaataagcccaccccgcctccgaggcaagactagatggctccaggatactctcggcgcgcccgctggccatctcgggcaggggagccccacacccggcaggaggaccaggacgcgagcggcggcgcctcggccctgggctgtttaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccg

SEQ ID NO: 15976 - DNA, 1077 bp, Homo sapiens
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacaaatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccgaagatctaagataaataaacaagagaactt

SEQ ID NO: 15977 - DNA, 1320 bp, Homo sapiens
atgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaa

SEQ ID NO: 15978 - DNA, 2878 bp, Homo sapiens
ggggactatttggttgaaagaaaacccacaatccagtgtcaagaaagaagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 15979 - DNA, 2776 bp, Homo sapiens
cgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 15980 - DNA, 2784 bp, Homo sapiens
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgta

SEQ ID NO: 15981 - DNA, 2066 bp, Homo sapiens
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 15982 - DNA, 1761 bp, Homo sapiens
catccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 15983 - DNA, 1864 bp, Homo sapiens
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 15984 - DNA, 1910 bp, Homo sapiens
ctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacctgtgatacctttcctctctattaatgttgacttcccttggttggatcctct

SEQ ID NO: 15985 - DNA, 1702 bp, Homo sapiens
ccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 15986 - DNA, 1799 bp, Homo sapiens
gcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 15987 - DNA, 1753 bp, Homo sapiens
ctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatg

SEQ ID NO: 15988 - DNA, 1571 bp, Homo sapiens
ggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcgg

SEQ ID NO: 15989 - DNA, 1604 bp, Homo sapiens
gagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaa

SEQ ID NO: 15990 - DNA, 1880 bp, Homo sapiens
gcctgatgtcagatgcgtctctgctgacctgagtctgccctgcaccatggacctgcattttccctgaagcatctccacgacggatgagatgactggccatgggctgagtctgagcttcaggacccatgtgcaggcagggattaaggtgcagagggacggccaaggatgcaatgggcaccgaggaggcaggaaagactcagagctcagcctgggctgcacagccaggtgtcaggtgcgtctctgctgatctgagtccaccctgcagcatggacctgcatcttccctgaaggatctccagggctggagggacgactgccatgcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaa

SEQ ID NO: 15991 - DNA, 2834 bp, Homo sapiens
aagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 15992 - DNA, 2094 bp, Homo sapiens
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 15993 - DNA, 2960 bp, Homo sapiens
gagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 15994 - DNA, 2046 bp, Homo sapiens
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcagcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 15995 - DNA, 2828 bp, Homo sapiens
aagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 15996 - DNA, 2018 bp, Homo sapiens
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgagtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 15997 - DNA, 2286 bp, Homo sapiens
gggactatttggttgaaagaaaacccacaatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 15998 - DNA, 2105 bp, Homo sapiens
aatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaat

SEQ ID NO: 15999 - DNA, 2204 bp, Homo sapiens
ctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggtcctgaggaccagccccttaaccccccagggtcaggccctcagaatcctccgggtctcggctctggtgcaggaacaagggctgcaggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaa

SEQ ID NO: 16000 - DNA, 2848 bp, Homo sapiens
tgcgtctctgctgatctgagtctgcctgcagcatggacctgggtcttccctgaagcatctccagggctggagagacgactgccatgcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 16001 - DNA, 2114 bp, Homo sapiens
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggaggtcctgaggaccagccccttaaccccccagggtcaggccctcagaatcgtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 16002 - DNA, 2822 bp, Homo sapiens
atgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 16003 - DNA, 586 bp, Homo sapiens
atgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaag

SEQ ID NO: 16004 - DNA, 2083 bp, Homo sapiens
cacttgttcaatgatgtacccccagtgtcaggcgctttgcaaacacacgatacatacgggttgatgtttggtcaagagaggaattaagaccaggcagacagcaggctgggatcagagagaccccatttctgtctgaaatgtctgcagagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttg

SEQ ID NO: 16005 - DNA, 4002 bp, Homo sapiens
ggcctgtgggaggcagaatagtgacctcccagagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 16006 - DNA, 2268 bp, Homo sapiens
gtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatgacagaaagaa

SEQ ID NO: 16007 - DNA, 2264 bp, Homo sapiens
cttgtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatg

SEQ ID NO: 16008 - DNA, 2444 bp, Homo sapiens
actctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggcagagcccacacgatgaagacccccaggcagtgacgtatgccgaggtgaaacactccagacctaggagagaaatggcctctcctccctccccactgtctggggaattcctggacacaaaggacagacaggcagaagaggacagacagatggacactgagagagtcctttcctctccaggcccccaggcctccccacccccaccacgttccttacctctcactctcccccgctgcaggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatgacag

SEQ ID NO: 16009 - DNA, 3100 bp, Homo sapiens
agctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatc

SEQ ID NO: 16010 - DNA, 2940 bp, Homo sapiens
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 16011 - DNA, 1612 bp, Homo sapiens
ggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcgggagggggccggaggagg

SEQ ID NO: 16012 - DNA, 2737 bp, Homo sapiens
ggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtggggcttggcccggcccagtcctggcctctgccaccaggtgtcaccgaggtttccccagccaatgttactctgctcagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatc

SEQ ID NO: 16013 - DNA, 624 bp, Homo sapiens
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16014 - DNA, 635 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatca

SEQ ID NO: 16015 - DNA, 554 bp, Homo sapiens
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccc

SEQ ID NO: 16016 - DNA, 680 bp, Homo sapiens
ggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16017 - DNA, 285 bp, Homo sapiens
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgaga

SEQ ID NO: 16018 - DNA, 648 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16019 - DNA, 565 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16020 - DNA, 345 bp, Homo sapiens
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtga

SEQ ID NO: 16021 - DNA, 624 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccc

SEQ ID NO: 16022 - DNA, 433 bp, Homo sapiens
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 16023 - DNA, 763 bp, Homo sapiens
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccc

SEQ ID NO: 16024 - DNA, 555 bp, Homo sapiens
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16025 - DNA, 532 bp, Homo sapiens
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16026 - DNA, 734 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16027 - DNA, 648 bp, Homo sapiens; identical to SEQ ID NO: 16018

SEQ ID NO: 16028 - DNA, 459 bp, Homo sapiens
atgttatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16029 - DNA, 382 bp, Homo sapiens
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaagg

SEQ ID NO: 16030 - DNA, 496 bp, Homo sapiens
ctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgt

SEQ ID NO: 16031 - DNA, 523 bp, Homo sapiens
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtcc

SEQ ID NO: 16032 - DNA, 624 bp, Homo sapiens; identical to SEQ ID NO: 16013

SEQ ID NO: 16033 - DNA, 689 bp, Homo sapiens
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16034 - DNA, 619 bp, Homo sapiens
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16035 - DNA, 603 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16036 - DNA, 610 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16037 - DNA, 565 bp, Homo sapiens; identical to SEQ ID NO: 16019

SEQ ID NO: 16038 - DNA, 665 bp, Homo sapiens
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16039 - DNA, 571 bp, Homo sapiens
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16040 - DNA, 668 bp, Homo sapiens
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16041 - DNA, 712 bp, Homo sapiens
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16042 - DNA, 585 bp, Homo sapiens
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16043 - DNA, 712 bp, Homo sapiens; identical to SEQ ID NO: 16041

SEQ ID NO: 16044 - DNA, 648 bp, Homo sapiens; identical to SEQ ID NO: 16018

SEQ ID NO: 16045 - DNA, 455 bp, Homo sapiens
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16046 - DNA, 254 bp, Homo sapiens
cacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaa

SEQ ID NO: 16047 - DNA, 648 bp, Homo sapiens; identical to SEQ ID NO: 16018

SEQ ID NO: 16048 - DNA, 259 bp, Homo sapiens
cctatgttctggggattagcaatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagaacactgcctggccctggagccactg

SEQ ID NO: 16049 - DNA, 565 bp, Homo sapiens; identical to SEQ ID NO: 16019

SEQ ID NO: 16050 - DNA, 619 bp, Homo sapiens
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16051 - DNA, 571 bp, Homo sapiens
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16052 - DNA, 689 bp, Homo sapiens; identical to SEQ ID NO: 16033

SEQ ID NO: 16053 - DNA, 610 bp, Homo sapiens; identical to SEQ ID NO: 16036

SEQ ID NO: 16054 - DNA, 455 bp, Homo sapiens
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16055 - DNA, 585 bp, Homo sapiens; identical to SEQ ID NO: 16042

SEQ ID NO: 16056 - DNA, 532 bp, Homo sapiens
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16057 - DNA, 565 bp, Homo sapiens; identical to SEQ ID NO: 16019

SEQ ID NO: 16058 - DNA, 712 bp, Homo sapiens
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16059 - DNA, 726 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16060 - DNA, 259 bp, Homo sapiens; identical to SEQ ID NO: 16048

SEQ ID NO: 16061 - DNA, 455 bp, Homo sapiens; identical to SEQ ID NO: 16045

SEQ ID NO: 16062 - DNA, 259 bp, Homo sapiens; identical to SEQ ID NO: 16048

SEQ ID NO: 16063 - DNA, 603 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16064 - DNA, 455 bp, Homo sapiens; identical to SEQ ID NO: 16045

SEQ ID NO: 16065 - DNA, 668 bp, Homo sapiens; identical to SEQ ID NO: 16040

SEQ ID NO: 16066 - DNA, 624 bp, Homo sapiens; identical to SEQ ID NO: 16013

SEQ ID NO: 16067 - DNA, 555 bp, Homo sapiens; identical to SEQ ID NO: 16024

SEQ ID NO: 16068 - DNA, 734 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16069 - DNA, 571 bp, Homo sapiens; identical to SEQ ID NO: 16039

SEQ ID NO: 16070 - DNA, 689 bp, Homo sapiens; identical to SEQ ID NO: 16033

SEQ ID NO: 16071 - DNA, 665 bp, Homo sapiens; identical to SEQ ID NO: 16038

SEQ ID NO: 16072 - DNA, 585 bp, Homo sapiens; identical to SEQ ID NO: 16042

SEQ ID NO: 16073 - DNA, 624 bp, Homo sapiens; identical to SEQ ID NO: 16013

SEQ ID NO: 16074 - DNA, 726 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16075 - DNA, 585 bp, Homo sapiens
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16076 - DNA, 665 bp, Homo sapiens; identical to SEQ ID NO: 16038

SEQ ID NO: 16077 - DNA, 259 bp, Homo sapiens; identical to SEQ ID NO: 16048

SEQ ID NO: 16078 - DNA, 532 bp, Homo sapiens; identical to SEQ ID NO: 16025

SEQ ID NO: 16079 - DNA, 665 bp, Homo sapiens; identical to SEQ ID NO: 16038

SEQ ID NO: 16080 - DNA, 689 bp, Homo sapiens
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16081 - DNA, 712 bp, Homo sapiens
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16082 - DNA, 689 bp, Homo sapiens; identical to SEQ ID NO: 16033

SEQ ID NO: 16083 - DNA, 532 bp, Homo sapiens; identical to SEQ ID NO: 16025

SEQ ID NO: 16084 - DNA, 764 bp, Homo sapiens
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16085 - DNA, 571 bp, Homo sapiens
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16086 - DNA, 571 bp, Homo sapiens; identical to SEQ ID NO: 16039

SEQ ID NO: 16087 - DNA, 565 bp, Homo sapiens; identical to SEQ ID NO: 16019

SEQ ID NO: 16088 - DNA, 619 bp, Homo sapiens; identical to SEQ ID NO: 16034

SEQ ID NO: 16089 - DNA, 254 bp, Homo sapiens; identical to SEQ ID NO: 16046

SEQ ID NO: 16090 - DNA, 712 bp, Homo sapiens; identical to SEQ ID NO: 16041

SEQ ID NO: 16091 - DNA, 624 bp, Homo sapiens
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16092 - DNA, 712 bp, Homo sapiens; identical to SEQ ID NO: 16041

SEQ ID NO: 16093 - DNA, 734 bp, Homo sapiens; identical to SEQ ID NO: 16026

SEQ ID NO: 16094 - DNA, 619 bp, Homo sapiens
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16095 - DNA, 624 bp, Homo sapiens; identical to SEQ ID NO: 16013

SEQ ID NO: 16096 - DNA, 726 bp, Homo sapiens; identical to SEQ ID NO: 16059

SEQ ID NO: 16097 - DNA, 532 bp, Homo sapiens
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16098 - DNA, 571 bp, Homo sapiens; identical to SEQ ID NO: 16039

SEQ ID NO: 16099 - DNA, 603 bp, Homo sapiens; identical to SEQ ID NO: 16035

SEQ ID NO: 16100 - DNA, 532 bp, Homo sapiens; identical to SEQ ID NO: 16025

SEQ ID NO: 16101 - DNA, 455 bp, Homo sapiens
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16102 - DNA, 254 bp, Homo sapiens; identical to SEQ ID NO: 16046

SEQ ID NO: 16103 - DNA, 254 bp, Homo sapiens; identical to SEQ ID NO: 16046

SEQ ID NO: 16104 - DNA, 726 bp, Homo sapiens; identical to SEQ ID NO: 16059

SEQ ID NO: 16105 - DNA, 764 bp, Homo sapiens
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 16106 - DNA, 603 bp, Homo sapiens; identical to SEQ ID NO: 16035

SEQ ID NO: 16107 - DNA, 648 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16108 - DNA, 668 bp, Homo sapiens; identical to SEQ ID NO: 16040

SEQ ID NO: 16109 - DNA, 254 bp, Homo sapiens; identical to SEQ ID NO: 16046

SEQ ID NO: 16110 - DNA, 764 bp, Homo sapiens; identical to SEQ ID NO: 16105

SEQ ID NO: 16111 - DNA, 585 bp, Homo sapiens; identical to SEQ ID NO: 16042

SEQ ID NO: 16112 - DNA, 648 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16113 - DNA, 764 bp, Homo sapiens; identical to SEQ ID NO: 16105

SEQ ID NO: 16114 - DNA, 648 bp, Homo sapiens; identical to SEQ ID NO: 16018

SEQ ID NO: 16115 - DNA, 585 bp, Homo sapiens
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16116 - DNA, 734 bp, Homo sapiens; identical to SEQ ID NO: 16026

SEQ ID NO: 16117 - DNA, 254 bp, Homo sapiens; identical to SEQ ID NO: 16046

SEQ ID NO: 16118 - DNA, 555 bp, Homo sapiens
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16119 - DNA, 668 bp, Homo sapiens
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16120 - DNA, 668 bp, Homo sapiens; identical to SEQ ID NO: 16040

SEQ ID NO: 16121 - DNA, 532 bp, Homo sapiens; identical to SEQ ID NO: 16025

SEQ ID NO: 16122 - DNA, 610 bp, Homo sapiens; identical to SEQ ID NO: 16036

SEQ ID NO: 16123 - DNA, 259 bp, Homo sapiens; identical to SEQ ID NO: 16048

SEQ ID NO: 16124 - DNA, 259 bp, Homo sapiens; identical to SEQ ID NO: 16048

SEQ ID NO: 16125 - DNA, 734 bp, Homo sapiens; identical to SEQ ID NO: 16026

SEQ ID NO: 16126 - DNA, 259 bp, Homo sapiens; identical to SEQ ID NO: 16048

SEQ ID NO: 16127 - DNA, 610 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16128 - DNA, 764 bp, Homo sapiens; identical to SEQ ID NO: 16105

SEQ ID NO: 16129 - DNA, 624 bp, Homo sapiens; identical to SEQ ID NO: 16013

SEQ ID NO: 16130 - DNA, 764 bp, Homo sapiens; identical to SEQ ID NO: 16105

SEQ ID NO: 16131 - DNA, 619 bp, Homo sapiens; identical to SEQ ID NO: 16034

SEQ ID NO: 16132 - DNA, 254 bp, Homo sapiens; identical to SEQ ID NO: 16046

SEQ ID NO: 16133 - DNA, 585 bp, Homo sapiens; identical to SEQ ID NO: 16042

SEQ ID NO: 16134 - DNA, 565 bp, Homo sapiens; identical to SEQ ID NO: 16019

SEQ ID NO: 16135 - DNA, 668 bp, Homo sapiens; identical to SEQ ID NO: 16040

SEQ ID NO: 16136 - DNA, 610 bp, Homo sapiens; identical to SEQ ID NO: 16036

SEQ ID NO: 16137 - DNA, 648 bp, Homo sapiens; identical to SEQ ID NO: 16018

SEQ ID NO: 16138 - DNA, 665 bp, Homo sapiens; identical to SEQ ID NO: 16038

SEQ ID NO: 16139 - DNA, 726 bp, Homo sapiens; identical to SEQ ID NO: 16059

SEQ ID NO: 16140 - DNA, 619 bp, Homo sapiens; identical to SEQ ID NO: 16034

SEQ ID NO: 16141 - DNA, 455 bp, Homo sapiens; identical to SEQ ID NO: 16045

SEQ ID NO: 16142 - DNA, 665 bp, Homo sapiens
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16143 - DNA, 571 bp, Homo sapiens; identical to SEQ ID NO: 16039

SEQ ID NO: 16144 - DNA, 624 bp, Homo sapiens
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16145 - DNA, 610 bp, Homo sapiens; identical to SEQ ID NO: 16036

SEQ ID NO: 16146 - DNA, 665 bp, Homo sapiens
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16147 - DNA, 254 bp, Homo sapiens; identical to SEQ ID NO: 16046

SEQ ID NO: 16148 - DNA, 555 bp, Homo sapiens; identical to SEQ ID NO: 16024

SEQ ID NO: 16149 - DNA, 726 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16150 - DNA, 689 bp, Homo sapiens; identical to SEQ ID NO: 16033

SEQ ID NO: 16151 - DNA, 734 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16152 - DNA, 555 bp, Homo sapiens; identical to SEQ ID NO: 16024

SEQ ID NO: 16153 - DNA, 734 bp, Homo sapiens; identical to SEQ ID NO: 16026

SEQ ID NO: 16154 - DNA, 619 bp, Homo sapiens; identical to SEQ ID NO: 16034

SEQ ID NO: 16155 - DNA, 610 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16156 - DNA, 603 bp, Homo sapiens; identical to SEQ ID NO: 16035

SEQ ID NO: 16157 - DNA, 689 bp, Homo sapiens
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16158 - DNA, 764 bp, Homo sapiens; identical to SEQ ID NO: 16105

SEQ ID NO: 16159 - DNA, 555 bp, Homo sapiens
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16160 - DNA, 603 bp, Homo sapiens; identical to SEQ ID NO: 16035

SEQ ID NO: 16161 - DNA, 712 bp, Homo sapiens; identical to SEQ ID NO: 16041

SEQ ID NO: 16162 - DNA, 668 bp, Homo sapiens
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16163 - DNA, 603 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16164 - DNA, 726 bp, Homo sapiens; identical to SEQ ID NO: 16059

SEQ ID NO: 16165 - DNA, 565 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 16166 - DNA, 455 bp, Homo sapiens; identical to SEQ ID NO: 16045

SEQ ID NO: 16167 - DNA, 726 bp, Homo sapiens; identical to SEQ ID NO: 16059

SEQ ID NO: 16168 - DNA, 764 bp, Homo sapiens
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16169 - DNA, 555 bp, Homo sapiens; identical to SEQ ID NO: 16024

SEQ ID NO: 16170 - DNA, 565 bp, Homo sapiens
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 16171 - DNA, 624 bp, Homo sapiens; identical to SEQ ID NO: 16021

SEQ ID NO: 16172 - DNA, 624 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccc

SEQ ID NO: 16173 - DNA, 624 bp, Homo sapiens
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccc

SEQ ID NO: 16174 - DNA, 345 bp, Homo sapiens; identical to SEQ ID NO: 16020

SEQ ID NO: 16175 - DNA, 624 bp, Homo sapiens; identical to SEQ ID NO: 16021

SEQ ID NO: 16176 - DNA, 345 bp, Homo sapiens; identical to SEQ ID NO: 16020

SEQ ID NO: 16177 - DNA, 345 bp, Homo sapiens; identical to SEQ ID NO: 16020

SEQ ID NO: 16178 - DNA, 624 bp, Homo sapiens; identical to SEQ ID NO: 16021

SEQ ID NO: 16179 - DNA, 624 bp, Homo sapiens; identical to SEQ ID NO: 16021

SEQ ID NO: 16180 - DNA, 345 bp, Homo sapiens; identical to SEQ ID NO: 16020

SEQ ID NO: 16181 - DNA, 345 bp, Homo sapiens; identical to SEQ ID NO: 16020

SEQ ID NO: 16182 - DNA, 345 bp, Homo sapiens; identical to SEQ ID NO: 16020

SEQ ID NO: 16183 - DNA, 345 bp, Homo sapiens; identical to SEQ ID NO: 16020

SEQ ID NO: 16184 - DNA, 624 bp, Homo sapiens; identical to SEQ ID NO: 16021

SEQ ID NO: 16185 - DNA, 1511 bp, Homo sapiens
ccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctag

SEQ ID NO: 16186 - DNA, 1467 bp, Homo sapiens
gcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 16187 - DNA, 1610 bp, Homo sapiens
agaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 16188 - DNA, 2139 bp, Homo sapiens
aagaaacttcctttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttata

SEQ ID NO: 16189 - DNA, 1908 bp, Homo sapiens
attctcctgcctcagcctcccgagtagctgggactacaggcgcatgtttgtcttttaaagcaacaagggaagagggcaagaggatgcatgggcttgggagtttattttctctcctcctgtctacacctcctctaatctgtctcccatgctgccacagagaaatctttctaaaagacaagtaccgaccatgcatatcccagttaagactcgtcgacttcttgcagccttaaaggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaatta

SEQ ID NO: 16190 - DNA, 2025 bp, Homo sapiens
atgtttgtcttttaaagcaacaagggaagagggcaagaggatgcatgggcttgggagtttattttctctcctcctgtctacacctcctctaatctgtctcccatgctgccacagagaaatctttctaaaagacaagtaccgaccatgcatatcccagttaagactcgtcgacttcttgcagccttaaaggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 16191 - DNA, 1616 bp, Homo sapiens
ttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaa

SEQ ID NO: 16192 - DNA, 1627 bp, Homo sapiens
ctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaa

SEQ ID NO: 16193 - DNA, 4110 bp, Homo sapiens
gccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttttttttttgagatggagtctcgctctgtcattcaggctggagtgcagtggtgcgatctcagctcactgcagcctccacttcctgggttcacatgattctcctgcctcagcctcccaagtagctgagactacaggcacatgccactacacccagctatcttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaaccttgtgagtggggtacatgtgctgtgggtatcggggtgctcgtgggcgccctggtggggcccctctcggtagttgagagtcacgtcctttagttccccatgatttacaattttggaagggacacaaagaaacatagacttcccccatcccagatgattccgagtacatagtctgcagataatacttagcaaaacgcagtctacagactcctaaagcagcttgtctaggaagaccacccatgtgggcttatcactccaggttctgtgacccgggaccttctgagaaaacagcactgctgtgaaatatcttccttgaagcctgtgataagtctccttgttagaatgactccaacttcctgccaataatctttgtcctctccataggagatgttctaggggatgccttccttccctccatttcacaaagaggccagacttgaggactaagtcattagatcttatcccttagaattttgcatatcagcatctgctaacctccacaacacaccctggcacagggtggggctgagggccccaggaaacaaagattcccaaaagtgagagggatgagtcattatttcctagagatgactgttgttttagagaaccttggtccaactctgttctgacaaggttttaggaagatggcaacaacagtggcagcagtgtactttttggatctttctcataaaaaaacaaaagagcaagtaagagagggaaaccaaatatccacatgcaacatccgcaacaaatctagtatgtcaaggtttgacatactcccatggaccccaaagtatgagccagtgagaatgagtcatcaatatctcaagacccatataccagcatctgtgcagaaggatgcagaaggaagcaaagggatgttggatggacctaagaagaggagatccccaagctgtctacagatccttactggaaggtatggtgcaccaatttgagaacagcagctgaaactgggagggacctaacggagtatttcccagtcctctcgcccattctgtatggtgagcacataataggtacttatttagtgtttgtcgaattaataaagttcaaatgacatttccctgga

SEQ ID NO: 16194 - DNA, 431 bp, Homo sapiens
gggcggagccggccaggcggcgcgagcgggaactacggccttggccttcttcagttctagcgtcaacccggtgctctacgtcttcaccgctggagatctgctgccccgggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacg

SEQ ID NO: 16195 - DNA, 710 bp, Homo sapiens
gcagcagtgtggaggtccaacgaaggagctccctgaatggcagagacaagaggaaatcagatgatttggaaaacttgggaggaagccatcaagctgggagatgaggactttccacaagcaagagctaactaggggcacaggacaggagtaggcacctcgcctactgctgcttaacctttcagcttctccaggcccccaatcctgcttgctcccagcttggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgcc

SEQ ID NO: 16196 - DNA, 3092 bp, Homo sapiens
aaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgatgactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatga

SEQ ID NO: 16197 - DNA, 1108 bp, Homo sapiens
gcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgc

SEQ ID NO: 16198 - DNA, 1515 bp, Homo sapiens
attcttgtcttaccctctgcaaatgtgataggcacaggacaggagtaggcacctcgcctactgctgcttaacctttcagcttctccaggcccccaatcctgcttgctcccagcttggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatgacttaagt

SEQ ID NO: 16199 - DNA, 1560 bp, Homo sapiens
accctctgcaaatgtgataggcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatgacttaagt

SEQ ID NO: 16200 - DNA, 666 bp, Homo sapiens
cttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 16201 - DNA, 1833 bp, Homo sapiens
catccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataa

SEQ ID NO: 16202 - DNA, 1879 bp, Homo sapiens
actttttcttactttttatctgggcgttggcgtacctttctcggggtgtctgcgtaactgcccagacttgccttggtttggtcagatgacacctcctctgggactggctagccagcgttcatgtctacattattgatctcgtcttccgatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataa

SEQ ID NO: 16203 - DNA, 2377 bp, Homo sapiens
cgcgcggccgccaccccaccatgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 16204 - DNA, 1968 bp, Homo sapiens
atgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 16205 - DNA, 1377 bp, Homo sapiens
atgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggtggggaaactgaggcacggagcagctgatgcccaaggtccagcagccatgctggtgggctggggaggcgctcagactccaagccaggcaggccgtgggtccggccgccccacagctggtaatgctgcacctccctctcctgtgatgtggccccaggccccgaccccgctcaggggtggtgggaagagtcctggagagcaggagcagtgccggagcccccactgcagctggtcccagcccctgcagagatccagacgcttgttttttaaatacagcagctctgcggtgcttttccttcctcaaa

SEQ ID NO: 16206 - DNA, 2058 bp, Homo sapiens
ggagggttttgctctttgtgtgggtgtgtgagtggctatgatcctagttgtccagctgctgcgtggagaataagtaaagcaggtctgaatgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 16207 - DNA, 2268 bp, Homo sapiens
agactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgagtgccaagcagatctgggcatggagcaaatgctcaggaaggctgtgggatgagcacatgaaatggatggaaggatggacggacagatggacagatggatggatggatggatggatggatgagtggagcccaacaccagctctcaggtcctacggaggtggcctctctcagcagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 16208 - DNA, 4747 bp, Homo sapiens
atggccgcggggggcagcggctgcacttcctcagcgggcggcggtggccggggagttaatcctcgacgcacgggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctc

SEQ ID NO: 16209 - DNA, 10390 bp, Homo sapiens
gcgaagcgtgaggtggagatgggggcggagggagctggagctgtcacagtccccgggtgcgcctgaccgagccaagtggggtgtcatggccgcggggggcagcggctgcacttcctcagcgggcggcggtggccggggagttaatcctcgacgcacgggtcggtgtgtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaaacaaaaagctgctggaatatttcaaaagatatatattttaccttattataggttttgtaaagttagtttgtaatattcaggtgcacttttaatgttaaattttgtgttcagagttccattataccatgtatttctcggaggtggctcatcacacggctggtggcagtcttggtgccgcagtgattccttaatatttgatttctctcttgatttgccactattctgtattggcactttcagtgtagatattctagtttggggatgtcctcacaatgtgtaatagagattggtctattagcatgcttaatttctgctaatcagagttttgcatggcccaaacaacagttgaccatttttatggtatgggaaagtgtagttcacaactgtctttgtcacgaaagccgtttttcctcacattttccagtaggcagataacattacttaaattattaatatataacactcttggaactattgataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttcaggaaaaataatttatatttgtgtataatactttttaatattaagtttgttgttctgaagtttagatgttgcttgataaacctttgctgcagcagatcatgaatatgagtaaggctttgtgtgataataggggtccttatgtgaagttaattactgttcagttctggtgagcaagctcaacaagtgtgaagtgtgtattagctttatttggtacacttttactttacaatatcgaagtgcttttagaactctggttatcttatataaaccattacctcaaccaattggcatttcttttccccaacatttaccttagctataatatgagctatgtgggatcagatggtaaaactataaaaggcacaatgagaagtttagttcccaagttttggagagaactctaaattagactaaaaacaactacctgttaacaccaatatcataactaccttctgtcgttaggcagtacatagcaacctttgagctgctagtgagctatctgttctccccctacccccaagtaagcacacagtgccaggcctggttctaagcctttgtgattctcttacatctcattgacccataatagtgaagcatggattcatttattttcataagacaaattgagtcagctcgatgtcagaagttgaaaatattttgagtagtttaacagttatatgagagattggcatcattttctttaacagcttttatctttgtagatttccttttgagacatgtatttttgcttttataatcctttcattaaatgccagaggttgttttcatattaatcactcttttctgtatattcaggttgctgtcattggtgatagaatatggcaatagacagaattgtgctccactttatgttttttaggagatattgaaagttataggttaaattttggccttcttgaagatatcaaagattgttttccttgttacctttaattagaatttggtcttcattaatgctttggtcaggctagcattactaaaaacttgatggcttcagcagaacagcccgtttaggagactattaagctatctagggattttttttcaaattaattgctttcaaaatctgaaaaggaaaaaagtataattgtggtacaaagaagacagatctccaggctctttcttctcagtttattttggtttaattctgtactggagacttgaataggatttgtgaacatggtgatggaaagaaaaatagaggacattatttgtgtaccctcattcctgaataatcttgcagtcaccttttaaagaagcagacattagccctgtaacacaacactgtagctataaactctaagtgttaggaaggagattggggtggggagggtggagtaggatggaaaaagcatgtagacttctgagaagaggctaaaaattctgccctataatactaaaaatgagtcacaagataatgtggtgaagttaggccatcttgatttgatagaaaaatcttttacattgtttaaaaatgagaatcgaggctaattaatgttgatttgacaatagaacatgagctaattctgcaaccgtttggggggtaattttatggtttccagttcatttagagctgtatcaagaaaagctaaaaagcaagcacttttagttaatcatagatttattggatatagcaaatattattataatatttaatctctattatttgaatgtggaaatgaactcttttaccccatcttgaactgtcattgaacatgctcaagatgatcaacactggaaatgaccctacacacataccaaaaaaatctaaagcagtaagacatatttgaagatccatacctcttaaactttttagatttgtcttgggaaagaatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccctcagaatgagtgaaacaacttctattatttggtgtacccggtgctacactcctaaaagtcttttttttttttcatccaggtgacgttttttatttttcctgcttggtggtggaaggttatatagtaaacttcactgtcattaagaaagcgcttgtccaaaatgtttaaagtactagaaaagggataattcagcactttttctgttacaacactaaagtcttaatttatcttcagagtcttaggtactgtaagtttttggatgattatttaaaaatataaaacatactacataatatggggtcagatcacatttatataaataattcttattttaaaaaagacaataacattttgtacctttctagcaattccaagtgattgcctcattttctcttgttaagcatttcaagcttaagaatttggaatttgagagaaggtgagggggaaaattccctaaaataaaaatttgtttcaaaccattttagaaaaataaatcactaggaaaataggtagggattctctccccctttaagtcttcagggaatgagcagtatttagaatctttggctgaaattcaagcctttttactttgtaaatttttaatattaattcactgacatgctttttacaccagaggactgaaaatggatcttaatgtttttaagttgtggaagggtatatttctaaaatgaggggggatgattaactaggttagtattaccagcattagtaagtttaaggaattttagtatgtaatagcaaagtgtttgattaaaagtctaatcctatattactagtcaaaattagttacattctgatctaggaaagataatagtcattggatattgatatgctgtgctgtcagaaaaccagactaagatagaaacctttatctgactcccacatgttgcttgttgtgatgggatgtatactttacagcagcttattgctgctttgaaaaaaaatgtataaactatacatttggagtgtttgcatataattctttataacctccacttaaagctgtcagacattggtattttatcagtccacattgttgaataaaactaatgttcttaggaatccagcttgtacacactgtttaaaaaccctcagggacagtttacacactcttctcactcaattcaggtactttgatgctattcttaaacctaacagtgacttgtatttttctgttttgcttttatttcaacgtgctggtagcacatctgatgaatgtcaacttaaaaaactcagttcaggtatccaggtataactcagccaaacagattttaaagctgcatataactctccagcacatggtgcctcacactcttatagtggcattctatatattcagttattactactgagcagataatatgggggttcctgttaacagtgtattttttaaaaaaagcgcataaatgtatagccagcacactacacacacacacacaaacatgcacagttaaactatatatttttaaatgccactaatagccagcacaactaaaacaaaagacattcctaactgctctgtaagctgttaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgtt

SEQ ID NO: 16210 - DNA, 4834 bp, Homo sapiens
gggccgggcgggcggcagaagatggcgagggtgtgtaggcggcagcaatgctccgttgagagacgcggctttcggcaagaactggattcgtggcgccacaagctcattcactgtgtaggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaaacaaaaa

SEQ ID NO: 16211 - DNA, 7777 bp, Homo sapiens
gcgcggggccgcggcggaggctgggccgggcgggcggcagaagatggcgagggtgtgtaggcggcagcaatgctccgttgagagacgcggctttcggcaagaactggattcgtggcgccacaagctcattcactgtgtaggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaaacaaaaagctgctggaatatttcaaaagatatatattttaccttattataggttttgtaaagttagtttgtaatattcaggtgcacttttaatgttaaattttgtgttcagagttccattataccatgtatttctcggaggtggctcatcacacggctggtggcagtcttggtgccgcagtgattccttaatatttgatttctctcttgatttgccactattctgtattggcactttcagtgtagatattctagtttggggatgtcctcacaatgtgtaatagagattggtctattagcatgcttaatttctgctaatcagagttttgcatggcccaaacaacagttgaccatttttatggtatgggaaagtgtagttcacaactgtctttgtcacgaaagccgtttttcctcacattttccagtaggcagataacattacttaaattattaatatataacactcttggaactattgataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttcaggaaaaataatttatatttgtgtataatactttttaatattaagtttgttgttctgaagtttagatgttgcttgataaacctttgctgcagcagatcatgaatatgagtaaggctttgtgtgataataggggtccttatgtgaagttaattactgttcagttctggtgagcaagctcaacaagtgtgaagtgtgtattagctttatttggtacacttttactttacaatatcgaagtgcttttagaactctggttatcttatataaaccattacctcaaccaattggcatttcttttccccaacatttaccttagctataatatgagctatgtgggatcagatggtaaaactataaaaggcacaatgagaagtttagttcccaagttttggagagaactctaaattagactaaaaacaactacctgttaacaccaatatcataactaccttctgtcgttaggcagtacatagcaacctttgagctgctagtgagctatctgttctccccctacccccaagtaagcacacagtgccaggcctggttctaagcctttgtgattctcttacatctcattgacccataatagtgaagcatggattcatttattttcataagacaaattgagtcagctcgatgtcagaagttgaaaatattttgagtagtttaacagttatatgagagattggcatcattttctttaacagcttttatctttgtagatttccttttgagacatgtatttttgcttttataatcctttcattaaatgccagaggttgttttcatattaatcactcttttctgtatattcaggttgctgtcattggtgatagaatatggcaatagacagaattgtgctccactttatgttttttaggagatattgaaagttataggttaaattttggccttcttgaagatatcaaagattgttttccttgttacctttaattagaatttggtcttcattaatgctttggtcaggctagcattactaaaaacttgatggcttcagcagaacagcccgtttaggagactattaagctatctagggattttttttcaaattaattgctttcaaaatctgaaaaggaaaaaagtataattgtggtacaaagaagacagatctccaggctctttcttctcagtttattttggtttaattctgtactggagacttgaataggatttgtgaacatggtgatggaaagaaaaatagaggacattatttgtgtaccctcattcctgaataatcttgcagtcaccttttaaagaagcagacattagccctgtaacacaacactgtagctataaactctaagtgttaggaaggagattggggtggggagggtggagtaggatggaaaaagcatgtagacttctgagaagaggctaaaaattctgccctataatactaaaaatgagtcacaagataatgtggtgaagttaggccatcttgatttgatagaaaaatcttttacattgtttaaaaatgagaatcgaggctaattaatgttgatttgacaatagaacatgagctaattctgcaaccgtttggggggtaattttatggtttccagttcatttagagctgtatcaagaaaagctaaaaagcaagcacttttagttaatcatagatttattggatatagcaaatattattataatatttaatctctattatttgaatgtggaaatgaactcttttaccccatcttgaactgtcattgaacatgctcaagatgatcaacactggaaatgaccctacacacataccaaaaaaatctaaagcagtaagacatatttgaagatccatacctcttaaactttttagatttgtcttgggaaagaatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccctcagaatgagtgaaacaacttctattatttggtgtacccggtgctacactcctaaaagtcttttttttttttcatccaggtgacgttttttatttttcctgcttggtggtggaaggttatatagtaaacttcactgtcattaagaaagcgcttgtccaaaatgtttaaagtactagaaaagggataattcagcactttttctgttacaacactaaagtcttaatttatcttcagagtcttaggtactgtaagtttttggatgattatttaaaaatataaaacatactacataatatggggtcagatcacatttatataaataattcttattttaaaaaagacaataacattttgtacctttctagcaattccaagtgattgcctcattttctcttgttaagcatttcaagcttaagaatttggaatttgagagaaggtgagggggaaaattccctaaaataaaaatttgtttcaaaccattttagaaaaataaatcactaggaaaataggtagggattctctccccctttaagtcttcagggaatgagcagtatttagaatctttggctgaaattcaagcctttttactttgtaaatttttaatattaattcactgacatgctttttacaccagaggactgaaaatggatcttaatgtttttaagttgtggaagggtatatttctaaaatgaggggggatgattaactaggttagtattaccagcattagtaagtttaaggaattttagtatgtaatagcaaagtgtttgattaaaagtctaatcctatattactagtcaaaattagttacattctgatctaggaaagataatagtcattggatattgatatgctgtgctgtcagaaaaccagactaagatagaaacctttatctgactcccacatgttgcttgttgtgatgggatgtatactttacagcagcttattgctgctttgaaaaaaaatgtataaactatacatttggagtgtttgcatataattctttataacctccacttaaagctgtcagacattggtattttatcagtccacattgttgaataaaactaatgttcttaggaatccagcttgtacacactgtttaaaaaccctcagggacagtttacacactcttctcactcaattcaggtactttgatgctattcttaaacctaacagtgacttgtatttttctgttttgcttttatttcaacgtgctggtagcacatctgatgaatgtcaacttaaaaaactcagttcaggtatccaggtataactcagccaaacagattttaaagctgcatataactctccagcacatggtgcctcacactcttatagtggcattctatatattcagttattactactgagcagataatatgggggttcctgttaacagtgtattttttaaaaaaagcgcataaatgtatagccagcacactacacacacacacacaaacatgcacagttaaactatatatttttaaatgccactaatagccagcacaactaaaacaaaagacattcctaactgctctgtaagctgttaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtg

SEQ ID NO: 16212 - DNA, 3587 bp, Homo sapiens
gtgacacgtgtcaatcaacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgactca

SEQ ID NO: 16213 - DNA, 4984 bp, Homo sapiens
tccccacctcccatccccattcaactgcaattccctctttttggttggatctgaatcgttttgcctcaaacttctgggcttggggctctcaccctgtggattgtttagggtgacaggaatggtgggactcccgaccttgctgcagtcgcttttttttttttctttttttgcctaagacgaatgcatagagctgttatccagcaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagtaaaagaaaaaaagaaaagaaaagaaaaaaactga

SEQ ID NO: 16214 - DNA, 5009 bp, Homo sapiens
aacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagt

SEQ ID NO: 16215 - DNA, 1013 bp, Homo sapiens
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaaggattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagt

SEQ ID NO: 16216 - DNA, 2953 bp, Homo sapiens
tttcaatccctaaggtctcagcaatgctttatctgtcggggcttccgtgatgtcacccatttcctggtctggagcgaccaatgccgtcctccttcctccaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagtta
